United States Patent 7,745,391 (HUMAN THROMBOSPONDIN POLYPEPTIDE) - sequence listing, part 112

SEQ ID NO: 327647 - DNA, 6872 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327648 - DNA, 4643 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggagcacccgcgagtaggggatcctctaaccagccag

SEQ ID NO: 327649 - DNA, 4453 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtgaaaggcaccgcaaaagaatcctctaagtca

SEQ ID NO: 327650 - DNA, 4193 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccttccttccttcctttccttggagcactgagcaccatttggaagcttgagagaaaccaaaattaaagagagaaagagagagcgtgca

SEQ ID NO: 327651 - DNA, 2522 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcttggtgaagatgtagtagaggattcggtaggcagtaaactcgcccacattgccaggcaagttctcggcgtacagcgacttgagctgcgtctggcactggttaaactcttcatggtcacccttctccaaggcgatccgggcatgggtctcgtacacctcc

SEQ ID NO: 327652 - DNA, 1232 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagcccctgaagtcacttgccttcaaatgtacccacactcccagagaacttctcacagccaataaatgactgataaaggctttcacaggttccttctgagagcacccccaacaataaaccaagtgcattcagatccctgtctcgagctctgctgcagacctgacctgagagaactctccactttgatttgcagccagaacctcccattccaacgcatcacccgtt

SEQ ID NO: 327653 - DNA, 952 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccgctcgcgatcgggtgggtgtggccagaacgtgaaccactggacaggatatagctgttccagcttagggagcccactcgggcagagtgactggtcatatttcgaagccgtttctgctgctgcacatcccatagctgcacctcagcactgctggt

SEQ ID NO: 327654 - DNA, 555 bp, Homo sapiens
ttttttttttttgaagctttcacttaatttttatttttaaaaccacagtcattacttacaatgcgcataacagatttatcatctttttctttgttaggatttgacaggtctggaacacatgctaataaattgctcaaaaatgcttcctgctgatatcacgcagctaaataatattccaccaactcaggaatcctactatgatcccaacctggtaagtggaatgggttacttttatgtacaacagaaagtacatccttatcaagtgttacttacagcatttctgtatagcacttcagaactagcagcaggctctatggttttatatgtctttgttgcaaaacagtagcacaggtaatccgaatcattcatagcttgctttggaatcttactgttcaccccatagatgcgtaatttggatttgttgcttatattccataagcggatgtcctgtttactaagggtgacagaaaatagccccagagtattctcattggccagagagaacaatcctgaggtttaaccatcaaggaaatattcatcacatggaatatcatc

SEQ ID NO: 327655 - DNA, 710 bp, Homo sapiens
gatggggttttaccatgttggccaggctggtctcaaactcctgacctcaggtgatccagcctcctctgcctcccaaagtgttgagattacaggcgtcagccaccacacccagtccagaactgtctttcaaaattgtaattacagcaagaatccctcttcttcctccgatctacaggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaaggtatgtttactgccaaacaaataagaatgggagcataaaacatccttgacaggtagagagagttttgaatggcttttgttatttaaaataatgattctctgtgtatccctttaccagccttgcattcaaactagttatgaaagtaagagaacaacataaatcactgaagaggatcttttcctgttattgttgcagtctggtgttttgttttgttttgttttgtttggaccaagcagatttaccttagctgaaaatatgtggtgaagttttaatttggaaacaaaaaaggatatcaataattcattaaataaagatggttcaaacactggaa

SEQ ID NO: 327656 - DNA, 7028 bp, Homo sapiens
  misc_feature (2302)..(2302): n is a, c, g, or t
gaaaactcagactcaaagaattaaaggaaaacagaggaaaaatgcccagttaaaaaaaaaatcatgtttctgttttttcctctagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggatctcactctgttgtccaagctggaatgcagtaatgcaaacatggctcactgtagcctcgacctcgtgggctcaagcaatcctcccacctcagcctcctgactagtggaaccacagacatgagctgctgcacccagctaaaatggagtatttttaatttctgggtcttttaaatgcatttggaggtctttagttttacctcactgaaattaggattttaattataaataatcaaagatgtgaaccttacagacattttaaagccattatattttttctataaaccctgttctcgtttggaggagaaagaaattggaattttcaaaaaaaataaaaatacctttaacacctatttagtgtctttagtaatccagtaaaatacttgattttttacnaaatgtttcccacaagccaagcaaaccataagctacaataataattacctagcgtacagccctctttgcatatgctgttccctccacttgaagtgtactgtttaatttcttaaaataactttagcttttaagaaccaattttgatgggagtacagacttcccccattttcttgatgagttctctccgtcatgtgtagtaataatgtgagaatttgcagtttttagttgtagcctatacttttaggtctttgtgccaatttgaaagttattgggttagagtattcatagacattttcatggtacttaaagggacaggggtttagtaaaaagacacatggcaagccaggctttttccacagtttgccaggcccagctgcctcttgtgtacctgaacagattttatcattaacccttgtttatgttgttttgttttatttcgacgaaggcttattttaagtcaggcatggaaaactagacttcagactgacttcagctttaaggacatgtttatcccgttaacagggagtctgggatagacaatctccaggctttgtttttctctgaatttcttagctctgcttgtgatggcttcatcatcaggccacagaccattaacacattctagaactttaacattggttaaataataccatctaatagcctgtcttcagcatttccccagttgcctccaaatgcccttcatagctgttctctgcctctgtttgtttttaatccaagatacactcaaggctcatatattaggttgacatagctctttagtatcctttaatttaaagcagtctccaggtttagagaaagatgaatgagctttcacatacccctcacttgtcttcttcagaagtgtaggctacaactaaaacttccttcttcagaaggaagacaagtgatttatatttatttacttccatttctatttgaccttgtttcatctaaacacacccactccaccactgctacctgattaatattaagtgaatctcaaacattgtatcattttagctccacgttttttgtatgtatctccaaaatataaagattcttaaaaatataaccacaataccattatcaccctaaaaaaatcaataatgattccttaatatgaccaactactttgtcaatgtacacctttcactcctcttaactttcataaagacttatgtgtttttttggtttttaagtttgttggtttgaagttaaatctatgggttttccctccatctctctttttttaaccgtataattttttgcatgtgtatatgaataaatctgattatagattctatagctatcttacactttgtccctctctgattgaatcctagttaacaagtttctatgtctcttgtatttcccataaattggtagttggatctgaaggctttatcaggtttgtttgattttttttttttttaattttggcgaatctacttcaaaagtattggcctacctacaagccactttaatgggcccttagtttagtgacctttgccttgaaaggaacttgaaacaagcaaggaagcaccactgtaatctgcttttttgccagaactgtagcatcttacagcttggttagagacatagtaagcagaaattatcaaattcatataatctgtagctataaggcactgtctctctctctcaattatttacatgatttttctttgtaatataactatcatttcagagaacttggttttgattttttttttttaatctttttgagacagagtctcgctttatcacccaggctggagtgcagtggtgcaatctaaagattgctgactgcaacctctgcctcccgagttcagcaattctagtgcctcagcctctcgagtagctgggattacaggcatgccaccacacccggctaatttttttgtatttttagtaaagacagggtttcaccatgttggctaggctggtctcaaatttttgacctcaagtaatcagcctaccttgatctcccaaagtgctgggattacaggcatgagccaccatgcatggccttcagagaacttggttttaggtacttacggattgtctttcttttttttcctcactgcagcctctccctcccaggttcaagcgattctcctacctcagcttcctgaagagctgggaccacaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327657 - DNA, 4965 bp, Homo sapiens
ctcaaatttcgaaaaacatcctggtgtgttactattgtcactcgaggattgtcaaggttcagccaggatggaatctgcccgttggtgacaatgaaaatattccgaacccatggtgcatgcctctcgattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327658 - DNA, 4441 bp, Homo sapiens
attcgagctcggaccctccttgtaatccaagcagtcgcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327659 - DNA, 3286 bp, Homo sapiens
ccgatctagaggatcccatttctggactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327660 - DNA, 2470 bp, Homo sapiens
  misc_feature (47)..(47): n is a, c, g, or t
  misc_feature (49)..(49): n is a, c, g, or t
tgagaaaggagggaatgaagttataataggatgttattaaggtatantnaaagtgtcggggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327661 - DNA, 2491 bp, Homo sapiens
ctaatatttgtttttgttttggaagaggaatgatggagatttgtttgttgtctttttaatgtataagattgtggaaatgattaaggtcatatggctcttagaaagtttgatgcacttatattctttcatcaacgtgagaattaaaatgtattttctgtctttcatcatttagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327662 - DNA, 5104 bp, Homo sapiens
actgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcaccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327663 - DNA, 975 bp, Homo sapiens
ggaaatgcatctggtctgtgtaggtctttttgttgtgttttgatattgtcttatcatttcaagattaaagatcaggccagttgcagtggctcacgcctgtaatcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327664 - DNA, 975 bp, Homo sapiens
gcctgggtgacagagccagactccatctcaaaaaaaaaaaaaaaaaaaaaaaaagaaaagaaaattcataggccaggtatggtggctcatgcctgcctgtaatcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327665 - DNA, 998 bp, Homo sapiens
tacttctgcacctaggctgtgagggaggtggaggctgcaacagggtgggaaggtagtcaaacatcccaggaagtgaggggagtttcttgattccagggtttccctccggccgtatcttttttttggattttccaggagttaactgctctttgaaaataatcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327666 - DNA, 5422 bp, Homo sapiens
actgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327667 - DNA, 4779 bp, Homo sapiens
gatggggttttaccatgttggccaggctggtctcaaactcctgacctcaggtgatccagcctcctctgcctcccaaagtgttgagattacaggcgtcagccaccacacccagtccagaactgtctttcaaaattgtaattacagcaagaatccctcttcttcctccgatctacaggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggc

SEQ ID NO: 327668 - DNA, 5125 bp, Homo sapiens
actgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagcaaaaaaaaaagaaaagaaaacagaaaccatgtgttgggggcgcgccggagcacccagggaaaaaaggttttacaacaccacgtggttggggcgccggctgggcccagtagggtaagcgacacactgtggccactcagcacgtgtcccaagagaaaaccgggcgcagacactgctgctgcggttcccaccaagttaaaaaggcccgggggaacccgagggtctggaaacaaacccggaaggggccggacgccataacgggctcaacacggggcaaggaagctattactaccgcgg

SEQ ID NO: 327669 - DNA, 709 bp, Homo sapiens
aagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgtaagtaacatccagcctcattctttctcatgctcaggaagagtaaataatctcatgataatatcattatagctaccatttattcagcacttccctgtgccggccatggaactaaatgcttttcttacatggtttcatttaatttacccaataaccctaataataaaaaatgtcatatgaaggtatt

SEQ ID NO: 327670 - DNA, 3047 bp, Homo sapiens
atggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctggtttttcatttatttggccaaaatgttatattaatggagttattgctatttttgctgtgataatggtattatgcaagaccatattctcaattatttggatatgcaaactaaagtattaagagctaatgtcattatatatgtaacttaaatctagacaccatcaaagcataaaataaaaataaaaagcgttgctgaatctgggtcgaaaatgtagtgcgtttatcccactattctctctgaaaatgttctttagaaagggtaacaaagatgctatccctccattttcagttctggagaaccttattagtttttcaaatatttactttatgatgaaacttaagtggtcacattggaaattattaatttcttaagtaattttttctgtaactgcttttgttgataatcctgttgtggaggaagagtcttataatgctctgggctttgctgtcactctttggtt

SEQ ID NO: 327671 - DNA, 685 bp, Homo sapiens
ggcacgagatggaacctttgtattgtaattatcatagagaagcacagtttgcatcatattatggcaatttattctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtg

SEQ ID NO: 327672 - DNA, 799 bp, Homo sapiens
tttagggccaaaaccctgtgaccagggttcaagggcaggagtcaaagccttagccactccaatgcttcttgaagtcctgttctacctaacttttgctggcctaatacatcttcagagtgtttctgataaacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcac

SEQ ID NO: 327673 - DNA, 439 bp, Homo sapiens
cccccccgcccgccgccccccatccctccaacacaaccactcccacccagcgccctgtccagttacgatcctaccgccccttcactccagccaccccattccattcacacatttcccacacaccggcccccctccaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtg

SEQ ID NO: 327674 - DNA, 4293 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327675 - DNA, 4326 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaaacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327676 - DNA, 4248 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327677 - DNA, 4347 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327678 - DNA, 2999 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgaaaaaaaaaaaaaaaacaaaaaaaaccaaaaaaacaaaaaactaatcaaaataaaataaaaaaaaaaaaaaacctcttgtcccctcaaaaagaaaaaaaataaatattcgggcccgaaaatggacctatttgggccattcccccttttagggggacttttaaaaattaaggggcgggggttttaaaaaccggggggactgggaaaaacccctgggggttaccccaaattaaatcggctttgagaaacaaacccctttttccccatttggggagatattgaaaaaaggggcccacctgatcccctcttcccaaacagtttgcccaccctaaatgggacatggagaatttgtaagctttattttttggttaaaacccgggtaatttttgggaatacaccttattttttaaccaaaaggcgaaaatcggaaaattcctttaaattaaaaataaacccgggaatggtgggggttgtttccctttggacaaagacctctttttacgggggccccctccgggccc

SEQ ID NO: 327679 - DNA, 2535 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgagcagtatgcgtcaagtgttccctcccctctttcctccccggcagtacgcacccc

SEQ ID NO: 327680 - DNA, 4277 bp, Homo sapiens
cgggcgggcggcggcggggagggaggaagaaggatgcaccaggctgaggctgtggtggaggcggcggcggcggctgcagccgcagctccagtcaccgcgtcgcctccccgctcctcctcccgcctctcggggttgcctctctccaggcgcagcccggaaggccggtggatggcgggcgagtcttgagaacggagggagaatcggtagttcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327681 - DNA, 4386 bp, Homo sapiens
ttatgctgttcctgagtgatccccttcgacggtgtctgaggaccgagagagtgaagaatggggaggggaagagagtggcacatggggttgagcagaggagaaagtcagaaaggtggcttggagaatccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtggaggtgatgtttcaccatgttgcccgtggctaatcttgaactcctgggctcaagcgatccatccgccttggcctcccaaagtgctaggattacaggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327682 - DNA, 4189 bp, Homo sapiens
ttatgctgttcctgagtgatccccttcgacggtgtctgaggaccgagagagtgaagaatggggaggggaagagagtggcacatggggttgagcagaggagaaagtcagaaaggtggcttggagaatccgctggggctggtcgcggagggggggaggggatgtcggtcagtgcgagatccgctgctgctgaggagaggagcgtcaacagcagcaccatggtagctgtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327683 - DNA, 3934 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327684 - DNA, 3680 bp, Homo sapiens
  misc_feature (46)..(47): n is a, c, g, or t
  misc_feature (57)..(57): n is a, c, g, or t
tgtgaggtgttggtggagggcgtgtggcgcgtgtagaagtagaggnnagaattaagnaacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327685 - DNA, 1714 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtgctaaggtgggtttcttggttaaacccccctctttttttttttttttaaacagggcgccccccc

SEQ ID NO: 327686 - DNA, 1341 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcac

SEQ ID NO: 327687 - DNA, 1325 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcacagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtg

SEQ ID NO: 327688 - DNA, 2498 bp, Homo sapiens
ggcacgagatggaacctttgtattgtaattatcatagagaagcacagtttgcatcatattatggcaatttattctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327689 - DNA, 962 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacagagatcaagtggtatgaaaaggtaggagttttaagctcaagtctcaaagataacctacctttacattctcagtcagaatttgacccagaaagaggaagtttcttcaggaacagaccgtacgttgatgaaggagaatctcggtccggccat

SEQ ID NO: 327690 - DNA, 153 bp, Homo sapiens
gtaagattttcttcagtgaatgactttctaaaatatctcaaaactgattaaaaatttgtatttatagtaagtagtacagtatgcacactgtattgatatagtctagattttcaaggataatactgatttcaggttcttgtagtctcaattttc

SEQ ID NO: 327691 - DNA, 4292 bp, Homo sapiens
ttatgctgttcctgagtgatccccttcgacggtgtctgaggaccgagagagtgaagaatggggaggggaagagagtggcacatggggttgagcagaggagaaagtcagaaaggtggcttggagaatccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327692 - DNA, 2480 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtg

SEQ ID NO: 327693 - DNA, 4235 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaagtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327694 - DNA, 2536 bp, Homo sapiens
  misc_feature (2504)..(2504): n is a, c, g, or t
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgctgatgcggccgacccccccactnctccattaccacaatccccccccccccctcac

SEQ ID NO: 327695 - DNA, 2544 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtggaattttttacaatacaaacaaaaaatacagaaatgcaatatatgaatacagctaaagtcgacg

SEQ ID NO: 327696 - DNA, 4884 bp, Homo sapiens
ttatgctgttcctgagtgatccccttcgacggtgtctgaggaccgagagagtgaagaatggggaggggaagagagtggcacatggggttgagcagaggagaaagtcagaaaggtggcttggagaatccgctggggctggtcgcggagggggggaggggatgtcggtcagtgcgagatccgctgctgctgaggagaggagcgtcaacagcagcaccatggtagctctgttggaatctggaacactggaatgatggaaatgtgttctttacaaagtagctgtgagtatactacataatttatagagtttttttcagtctcagttaacttaaatttaatttatagttggatgaaatatgagccaaggaaaccttaggtttaatgcatatttctaactccactcatagcagactttcaaatatttgacttaaaaatgttagattctgattagtctcctaattattatgtttatagttagcttttcattttaatgggcttcgtttttaaaatttggcttaagaattagttttatgaaatgaacaaaagagccaaagattatggatggaatatttagctacatgactagtaaacattgtagacttctgttctttgttaaatccaaatgtattgaattgatgttttgatcccatgattgctttttaaatgagaatttaaatgtggcagaaacttttaagagaatgtgtgcctctttttgctattttttaatgttgagataagactgcctccaaagtaaaattaaccaatgagactctgcttattcaaatagtcttaactacggacagcatttctcacccatggcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327697 - DNA, 4250 bp, Homo sapiens
ttatgctgttcctgagtgatccccttcgacggtgtctgaggaccgagagagtgaagaatggggaggggaagagagtggcacatggggttgagcagaggagaaagtcagaaaggtggcttggagaatccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327698 - DNA, 3924 bp, Homo sapiens
atctccttatgagcaatctttaaaagtaaaatcagttcagagctgctcaacacacaagttttcagtgggttggttaaataattcctggtcagtgggctatattcatgccacaaaacagtatggtactggatattttccttcttcgggccaaactgctaagcatcacatcacaaagacatctctgtgaagctgagttttaaaatgctcagtaaatgctgaggtagatggttttcaaatgaagatcttctatactctgattcgattgggactagcttctttgtgtatcctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327699 - DNA, 1814 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgagctattgtttgtggccttgtgttgtccctcagtgtcaaatctctagcgctgacctccgggtgacctcctccattgttaattgccctcacgcccctccgctattgtgctttgtggccagcactcttgataagatcttggtgtttaaacaggcatagttagaacctaattt

SEQ ID NO: 327700 - DNA, 1714 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgatgtctagagggggggggttcccctctggggggggggggtggacacccccctttttctttttttttatat

SEQ ID NO: 327701 - DNA, 2121 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtg

SEQ ID NO: 327702 - DNA, 3137 bp, Homo sapiens
  misc_feature (56)..(56): n is a, c, g, or t
ttacatgataccaatatcgtgagtgcgcgcaggtgctctgataagttaacggtcanacataggtcagtttgcatgtatctcgtagggacatctcgtggttctgtagatcagtgcttgcgccttgtccccatgtaaaaaaagtccggaggcacacccgacgcgtgacatgagggaagagatccagagtggatctgctcggagtcttgtaacatggcctctctgagaagcgtcgtccaacgctgatgctcagatactcaccagtaactgctccaggagcaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgactcgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttaaaaaaaaac

SEQ ID NO: 327703 - DNA, 1747 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaaacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattattttttttttggttcttgatggagattaagatgccttgaattgtgctaaggtgggtttcttggttaaacccccctctttttttttttttttaaacagggcgccccccc

SEQ ID NO: 327704 - DNA, 1119 bp, Homo sapiens
agcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtg

SEQ ID NO: 327705 - DNA, 1284 bp, Homo sapiens
ttatgctgttcctgagtgatccccttcgacggtgtctgaggaccgagagagtgaagaatggggaggggaagagagtggcacatggggttgagcagaggagaaagtcagaaaggtggcttggagaatccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatgggtcagtaccttgatacttctgattccttttttgttgttgttgcttactgttacctttatgtgcatactttagtaatctttaagtttgtgaagtacacacaactatagccattatgaagtactaaatttcatgtagaaatgtcttagttgaaaagccattttaagtcctatataagctaacagtgattttactccttagttcttcattcataaggattttccctgcttcatgaaataaacagtgttgccaccatggtttgaggtctcaatgtggcaaatttagctttcatgttgaccactctgctactaatagaaataccaaataaagagaagcagccataccagttagacatattcaaaataaatccaaagatgctatttattataagtttcatagaaatgattatcaaaaacacttgcatgccaatgttttcttgtgccatttctttctacaataaatctatttggcttctgtttcaccttagctgtcatagacgtgttgttcaggtatcatattgtcagtactaatcttttgtttattaggacttaagacctaagaatctagacattaatctaatctgattgttctgtttgttatagttagcctgtactccc

SEQ ID NO: 327706 - DNA, 422 bp, Homo sapiens
tttcttaacttttgaagttctttatttagaatgtatctaagtgcttgcatttttttcttaatctcttttgtcccaaaatagactctttttaatctaaaaatgcacgactttcctcaattcggggaaacattcttctttccatctgtgagcatttcctttcttctaatctctttcctcctctgtctcactctcttctggtaaaactccacaacccaggcatctagacgaatgattcagtgtttggccattctgctactcagacatatctcaggtattttaaaaatttccaagaactctgataatttttattccttatgttttttttctttttctttttacttctcaggttgtaacctgtgaatttatcctgaatacccccaggttggcagctttcttgaagacagcagagggcccctcccttc

SEQ ID NO: 327707 - DNA, 411 bp, Homo sapiens
ctcatggggccagtactgttatccttgctttattgatgtggaaacagggtcttagggaggttaagtgacttgcccaagatgacccagtcttgaactcagatgtaccgtagaggaacttccacttgctatcctcaggccccggagaggcccacgggcagaggaagagtctcagtcaccctcttggaccagcccgtccccacctttccaaggggagctagaggctacagatccctgggcctctgatgccccagtcgggggtgggcgtatgaggtctccagctgtgaagagtcagcctcttgaccctagaccatagttgctgggctcagggcatcacctggcatcttctagaagtccatgggacaggacaagaggtgccagcagggaactcgtccaggcaggggctttgggttc

SEQ ID NO: 327708 - DNA, 4284 bp, Homo sapiens
agagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcgatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 327709 - DNA, 4308 bp, Homo sapiens
ctcccggagcgcgggtcccaccgcggaactgcggaccgtgtggccctggggcctgcaccctctccggctccggggacggcgacagagacctgcccacccaggcctgggggccccagtcagtggcggccgccgtgtgtgcgctcggtgtctgcggggccagcaggtcttcctcaagccggacgagccgccgccgccgccgcagccatgcgccgacagcctgcagcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggcagttcctacaagcacaattaagtggaggcagcatgagggatgaagaacccaggacaattaatcatcaaggagtgacatttggtgcaaactcagggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcgatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 327710 - DNA, 2443 bp, Homo sapiens
ttagaggatcccctgcactgtagatctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcgatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 327711 - DNA, 4581 bp, Homo sapiens
agagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcgatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctaccaaaaaaaacaaccatacccacacagacacacaaaggcgcggcacgcgacacagaagagaaccaccacgaggggcgccaaggtaaccgcgttcccacaggcctgcgcacaatcggggcccctaagaaggacgcgagatacaagacgccgagacacagggcgaggcgtatcacagacgccggagaggcgagacaccgggaccccggcgcaccccgggaagaaaccctcaacccgcgggcgccaccacactgggcgccacacacacgtgaacagccactaaacaacccacggcacgaccac

SEQ ID NO: 327712 - DNA, 4354 bp, Homo sapiens
agagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcgatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgacccatgattatcggaaaaccattagttctgattttgtgggttgctatactttggagaccaacagtttcttgacactgagtcagggcaatccgtttagaaacctatcttaatcgttctagagttgatatgcttttgatcactgccttaagggggggtcaggtccctaatattcgctttcctgaagtttttcccaatcagttgggcgag

SEQ ID NO: 327713 - DNA, 975 bp, Homo sapiens
  misc_feature (25)..(27): n is a, c, g, or t
  misc_feature (32)..(32): n is a, c, g, or t
gcggcccctactactactaaattcnnngccgntcgacgcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 327714 - DNA, 1152 bp, Homo sapiens
ctcccggagcgcgggtcccaccgcggaactgcggaccgtgtggccctggggcctgcaccctctccggctccggggacggcgacagagacctgcccacccaggcctgggggccccagtcagtggcggccgccgtgtgtgcgctcggtgtctgcggggccagcaggtcttcctcaagccggacgagccgccgccgccgccgcagccatgcgccgacagcctgcagcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggcagttcctacaagcacaattaagtggaggcagcatgagggatgaagaacccaggacaattaatcatcaaggagtgacatttggtgcaaactcagggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcatgtgagtgggagtggggccatgtgcaatgaggctgaagacccttatcacagctggtgggaagatggcctggccagggagctggacagacctgggtttcagcttcggctttgctgcttttgagctgtgtgaccttgagcaagtcactaaacgtctctgggcctcagtttcacacctgaaaatggggataatgatagcaccgactgacctagggcagtggtgaaacaaaactggtcaaatatcttgtaaatacacacggttgccaacttacaattttcgactttttgatggatttatggggaagcaaccctatcctaagtccaggagcatctgtacttagaaagaaccctccacataatgatactga

SEQ ID NO: 327715 - DNA, 605 bp, Homo sapiens
aagtgctcggggaagaggtcagctttcccgtgagtcccgcgtctgtcttctcgttggagtctgcaggggcggttgaggccgggtagacactcctgggatctgcctggagtatttggatcttctagactcttggaatccgatggaattatctggatcttgggactacttagaaatgctgcagggatcacaacctgtgatcagcaggctctattaggaagaatctcttagcatctacagaaaggcttacctgggacctgttcacttctgttggagtatttctggatatggatctgctagaatctgttgacgagaatccttggagtctgcttatctctctcgtagttagggaagactctagagtcctttatagcgaattctgccagactcccctccatctctgctcatcaatgctgaccctgtccaccatttggactgactgaagggttctttgaaacttccagatttgagggtggggacaggttgagatcccctgacctggggagtactgggccctgactcagtctctcctcaccccctagttgacaggatgcctgggccaggtggtggaagacaagaagtccatccagctgaaggacctcacctcc

SEQ ID NO: 327716 - DNA, 321 bp, Homo sapiens
tgaggagtctgaggctcagagtggtctagggactcaccctgggtcacacagagggttgaaacagagctcagaaagggaactggggcccctgactccccctttctgactgctctgctgacctgggggctggagctggacgaggcccctgcttcctctcttggggtcaatggtaagggagcccatctgccccagctgggcccccatcactcctctccccccagaggcaccactttgctcaggccatcgccatcctcaacacccacggctgcaacatctttgatcatttctcccggaaggtgatggggttgggggtggggtggg

SEQ ID NO: 327717 - DNA, 321 bp, Homo sapiens
agccgctctgcggagaaacgcgctcccggagcgcgggtcccaccgcggaactgcggaccgtgtggccctggggcctgcaccctctccggctccggggacggcgacagagacctgcccacccaggcctgggggccccagtcagtggcggccgccgtgtgtgcgctcggtgtctgtgcgcacgtgtctccctcgcagatgggcgactgctccagggcctgtccgtctcacagcgacctccaacattctcccgacttccccctgcctcctaggctgagggagaggagcaagcccgaggctcctgcggtgtccgcggcccctgcc

SEQ ID NO: 327718 - DNA, 4062 bp, Homo sapiens
tcgagctccgtacccccccgaccagcccgacagctccccgactagcccgacagccccgactagcccgacagccagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcgatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 327719 - DNA, 521 bp, Homo sapiens
catcgagctcgtacccgacttccaccggagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctaccaaaaaaaacaaccatacccacacagacacacaaaggcgcggcacgcgacacagaagagaaccaccacgaggggcgccaaggtaaccgcgttcccacaggcctgcgcacaatcggggcccctaagaaggacgcgagatacaagacgccgagacacagggcgaggcgtatcacagacgccggagaggcgagacaccgggaccccggcgcaccccgggaagaaaccctcaacccgcgggcgccaccacactgggcgccacacacacgtgaacagccactaaacaacccacggcacgaccac

SEQ ID NO: 327720 - DNA, 543 bp, Homo sapiens
tttttccagttaacttcatgacatgtagacattcaaaacttgagccttggatgttcctgtggacctgacagttaaaaatataaagaacctaagattcaaatccaactttctctgtttgccttgggttgaataacttatcttttggagaatagttttaagtgccttggacactgataaaattcagctatattgttgacactcatctcttttgtcttatgcttagccatatttaaatcttaaatttaatagagtctagtgaaaaaatgagtgggaagaatgaatataaaagtaataatataaggaaaaagggaaagtaaactatttagaatgtagttttgttatattcccagcatttcaatatttattagttacttgtaaattactgtggctgtgtagcttataaatgtctgtgcactatattaattagaagaccatagaacatgccagcaggttggctaatgctatgggggattttaccacagttgccattgtggaagaaattatttggtacattaataaaaaaagttggtaaaacatggtttt

SEQ ID NO: 327721 - DNA, 245 bp, Homo sapiens
agccctagatcccttaaaccttaattccatacaacacatgtttctgtgagcacaaggctggagaaaagttacagattaacagcatctcaaggcaaaaccattgttcagggtacagatcaaaatggagtttcttaagtcttccttttctaaatagacacacttgtgataccctaacttgtattaacctgattgactctctcttagctgagaaacctgaacggactccatttggctccttcatttgc

SEQ ID NO: 327722 - DNA, 2186 bp, Homo sapiens
aacgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatag

SEQ ID NO: 327723 - DNA, 944 bp, Homo sapiens
aacgtgatctcgggtttgtcgggctgaaatgtggcgggtctcggaaggttccgacctcagtaaagagagctaacgtgtattcttctttttcttagcgtgttgctttgtcgcccacgctggttgcagtggtgcgatctcagttcactgcaaccttcgcctcccaggttcaagcgattatcctgcctcagcttcccgagcagctaggactacaggtgtgtgccatcacgctcagctaatttttttggtatttttagtagagatggggttttcccatgttggccaggctggtctcgaactcctgacctcagatgatctgcccgcctcggcctcccaaagtggtaggattacaggcgtgagccactgtgctcggcacattttggtatgtttcttatttaactttctttttaaaaaatactctatgtgcttttttttttttacatgtataccttatattgtagaatattttttaaatgtaattgagattctattttgttccttgcctttcttgcttaatataattgtcaccatttaatataactgtagagcttttcaccagccctactttcttggtctattaatacttgaacttttcttcctttaggatctcagctaaacgggaagcatttttgaaaagtgattgcacaattgagagtgaaaattactgagtcctgaacaggcaacttacattctaataccagctctgtctccatccagccgactgaatagtcgtgattaagttacttgacttccttggatatctagatccttaaagttaaagaattatacaagataataatattttcttcaaactttagaaaatgactttatgaaccgccttaagtttgtatgttttcatagctttcaagagcttgtttacacactcaattctagattctagatactttctagaaaataactgacttaactcattcaattgatatatt

SEQ ID NO: 327724 - DNA, 2308 bp, Homo sapiens
aacgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatag

SEQ ID NO: 327725 - DNA, 2470 bp, Homo sapiens
aacgtgatctcgggtttgtcgggctgaaatgtggcgggtctcggaaggttccgacctcagtaaagagagctaacgtgtattcttctttttcttagcgtgttgctttgtcgcccacgctggttgcagtggtgcgatctcagttcactgcaaccttcgcctcccaggttcaagcgattatcctgcctcagcttcccgagcagctaggactacaggtgtgtgccatcacgctcagctaatttttttggtatttttagtagagatggggttttcccatgttggccaggctggtctcgaactcctgacctcagatgatctgcccgcctcggcctcccaaagtggtaggattacaggcgtgagccactgtgctcggcacattttgatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatag

SEQ ID NO: 327726 - DNA, 2415 bp, Homo sapiens
aacgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggctcagtctcattccacgggtggtagtcgtgaccctgcacattccacattcctatccttggattctgtgagatcacctggtattctcattatgacttcttctgttaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatag

SEQ ID NO: 327727 - DNA, 1199 bp, Homo sapiens
  misc_feature (548)..(548): n is a, c, g, or t
  misc_feature (593)..(593): n is a, c, g, or t
  misc_feature (714)..(714): n is a, c, g, or t
  misc_feature (761)..(761): n is a, c, g, or t
  misc_feature (764)..(764): n is a, c, g, or t
  misc_feature (782)..(782): n is a, c, g, or t
  misc_feature (818)..(818): n is a, c, g, or t
  misc_feature (919)..(919): n is a, c, g, or t
aacgtgatctcgggtttgtcgggctgaaatgtggcgggtctcggaaggttccgacctcagtaaagagagctaacgtgtattcttctttttcttagcgtgttgctttgtcgcccacgctggttgcagtggtgcgatctcagttcactgcaaccttcgcctcccaggttcaagcgattatcctgcctcagcttcccgagcagctaggactacaggcactctcagcctaaacgggcaagcacttctttgacaaaggtgacttgcacacacctcgacgcagctgacacaacttacctgacctccctgaacacggcaaccttacacttactaacataccagccctctgctactccactcacagcccgcacctgacactacgctcgcatgactctacacgcttaccttgcaccctatcccttgcgcactactcctacagcatccccttcaacacgcttcaacaccaactctactaacccacacgaactaccactacacttacttctctcctctccaaccactctctacgcacaaactgcaccttctactcgaancacgcccacttacagcgctttactgacatgcacgcaactgcacanctccgctacacccctgactggctcgctctctgcgccatctctctctaccgaacactcacactccatcctcataacctgcgctctacccacatcccacgcatcgctacaccactcacaacgnctccacactctccttccactccacactctctcaagcaccgacgtatnacnactcgtctgcactaccanaccggccctcgccaacgctatcctctaccgcacccnacacagcaagcgcacatttcagcccactttcctatccactacctcgacttcaacagttcacacgatatctcggcctccacgcgcacgcatcactctcgccncactccaaacgcaacacccagacgactgcctcctgcgcacacgcgattcacaacgcaccgaccacgcaacatactcattgcgcacgaaccctcgcacgtaaacggagctaccgaacaccacctctgcagcgcaattgctcctcgccagccatattcccctgctgcacatcgaagcaacaacccggcaacggttccttgaaacagcaaggccatgcctcgagcttggcaccctctttgccagcccatattccgagcacacatccagcgagaactgaaccag

SEQ ID NO: 327728 - DNA, 767 bp, Homo sapiens
aacgtgatctcgggtttgtcgggctgaaatgtggcgggtctcggaaggttccgacctcagtaaagagagctaacgtgtattcttctttttcttaggtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcaggtcgtgttgctttgtcgcccacgctggttgcagtggtgcgatctcagttcactgcaaccttcgcctcccaggttcaagcgattatcctgcctcagcttcccgagcagctaggactacaggatctcagctaaacgggaagcatttttgaaaagtgattgcacaattgagagtgaaaattactgagtcctgaacaggcaacttacattctaataccagctctgtctccatccagccgactgaatagtcgtgattaagttacttgacttccttggatatctagatccttaaagttaaagaattatacaagataataatattttcttcaaactttagaaaatgactttatgaaccgccttaagtttgtatgttttcatagctttcaagagcttgtttacacactcaattctagattctagatactttctagaaaataactgacttaactcattcaattgatatatt

SEQ ID NO: 327729 - DNA, 204 bp, Homo sapiens
gtaggttttcagaggtcgactagtttcaatagtgctgtataaaggaatgctgtttttgctagactctgcttcggtgctcatagtggtttccaaacactgttttaagtgttctcttatgataagtgatcaagctggtctcctgtaatttgctgcagaatgagaatgaagaaattacgatgtcaaataataaagactcccagggta

SEQ ID NO: 327730 - DNA, 2257 bp, Homo sapiens
aacgtgatctcgggtttgtcgggctgaaatgtggcgggtctcggaaggttccgacctcagtaaagagagctaacgtgtattcttctttttcttaggaaagtattccatgctacatgtgcaagaaacttggaaaacactgaaaagtagaaaaaatagcaagcaaaagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatag

SEQ ID NO: 327731 - DNA, 1293 bp, Homo sapiens
gtatccatgtgcgtggagtacgttctgctctggaaggtttaccagaaaaccccagctctagctgtgaaagctggtcttaaagaagaggaaactgaattgaaacagctgaatttacaccaagatactgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatag

SEQ ID NO: 327732 - DNA, 1294 bp, Homo sapiens
aacgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttataaaataatataagtattactaattagaaaaagtggc

SEQ ID NO: 327733 - DNA, 359 bp, Homo sapiens
atctcttccccatttgtgggctatacaggcattgtggtgagataggtgagaaggccagagtgtgggagaggcaagagctgagattggagaatctgaattacagcatccaaaggtgtgtggtgagcacaggccagtgcctgcagggctccccttcctggtagccaagcaagagcaggatcctgcatagcgaagcaggtggccacattgtcctccccacaagatccatgcccatcagaaggaaattccagccaagggctgggcaaggactcagttctagccaggcaggctaaggattggattaaggatccatgcccatgaaggggcagagggtagggagaactgtagccagcctcaggaaa

SEQ ID NO: 327734 - DNA, 5506 bp, Homo sapiens
ggggtgagagagagagagtggccagtgctggcagaaagcacagccacctcggggctctgcatcgtggtggggccaggcgggtcggcaggtgctggcttgcgaggttgtcctgcatgcggtcactcgggtatcgaatgagtgcgaaagtggatttaatacagtcactgagaaaaactacagcttcacgagactgaccagcctggtgagataaacatttaccgtcagacactctttagctgtctgggcattgtgtgagttctttggcacatgcgcccagcctccttccccacagggtctcgcctggggcattagaagctggattgtaacatttgttttaaaagatactttgttaggctgttggttctccttacaatcccggctttccttagcatgtggttcccttcattgtatctgggtttttctatctcagtctgtcctttatacaagctttttcctctagcactaattatattccccttcccctttttccagaattccaaattctgacctgtgcatgcatgcctgtgttgagtacatgctgtttgtcggatatttggtggtggggggaggggatcacatttctgttactctcgcattgtttccttaggatgaattcttagaagtggaacttctggattcagggaatgaacacgtttgctagttactgtcaaaaatgcctcttggagaagttatgccgaaccacccaactgtcctggtcacagagcaggcttctctcggcttggggctagggttctttctggggtcgtcctttttttttttttttttgagacagagtttcgctcttgttgctgaggctggagtgcagtggcaccatctcgtctcactgcaacctctgcctcctgggttcaggtgattctcctgtcccagccttccgagtagctgggattacagggatgtagcaccatgcctggctaattttgtgtttttagtggagacggggtttctccatgttggtcaggctggtctcgaactcccagcctcaggtgatctgcccgcctcggtctcccaaagtgctgggattacaggtgtgagccactgtgcgtggcctcccagggtccttcctaatgcaggctgctttctctcatgtaaccaagagacatacattcatcccctaccacgtgccaggctgcactgcgtgcagatgcccctgcgctcacggggactggagggagccaggtgacatggagcccaggaagtggccagagctcgggaggaaggcaaagaggggaagagggcatgcagtcttaggcttggggtcccaggaggcctagggaagccttgtagatacccaggtacagcatttctgggatcaggagccatgatcccaaggcctctaatacttcagatatggcagggaggccaggtggagagacctggaggagtgaggccacagagttggggggccatggccgagacttcggcttctatccagagtcagatgggagctgttggagggttgtcagcaggtgagtgccgtgctctgacttgggtgttaataggatcatggtagctggctgcaggtgtcctgggccaaggagcagggagacaggaggcagagaagagggcgctgggttggacctgggacgcctggggtggtgagaggtggtcgatgctggtcatgctgtgaagcagtctcagtgagttccaggcgaatgagcagattcgttttagggagtgcctgtgaagagcaaacgctcttttttggtgttgctgccagatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtgttagtgtgaacgcaggcctgggtgcctgggtccggtggctgcaaagatcagtgatccatactcggttctctctctgagctggatctagccttctgtgtggggatttcatggagtaggatatatattttgagaagaaaattctatgattgaagtagagaaagtgaggttgggaaggaaggatgaggccagatacagtcctggaatgactgagaaagtatgtttaatggttaaggtttatttacatacataaaatatccacaacaatcataaaaattaaccagtaagggttaggatgcagccagagagcgtctcaaaggcatgtgtgcggcacagcggcctgcaggttgtaagtgcccactaaatggtggctgttgaggtaattaaccagcaaaactgagatcctgacattctcacttttcagtaagtatttgtcttgatctgtttcgtgtctaattacatattgaacttcggccattattttattggaatgggagagtgatgatccaaataggaaggcaccctagcagagggacagggggaagaaacggtaactcgtgttgggttttaaggagagggtggcggttccatcctgtactgctcccagctcccccagaagaactggagaaataccagcaaagggctgtgtagacaactcacatttgctcttggattgtttgctggggacaactcgatttctaatgacagcttccgtgaatcaacatttcttccttaaagctacacactctcgggttgttgggtttccgaagtttagtttctcaggctcctacttgtaagtttcagatattatggttctgcaaaaaagggtcacctctctccctcttcctgtgttggaaggtgacgtcctccctttagtttgtggccaacacttgtttctgaaactttttacagcaaacagagtatctgtatgaggttatgttgagggtcgcttgttaaaagctgctgcctgacagctgttaattctggggctagtgagacacataattatggtgtttatactctaaaatttttgccaaaagaatctctaccccttttgtaaatatatagacataaatgttattctatgtaaatacagatgcacaattttataaagtatatgatcgcacatcaatgtatgtaggaatcatgctggttctcagggcattgcctgtcagctccagattcatcaggacctgctcagcagcggggtcggggagctgggcctgggaacagccctggcttggttcaggccgctccagggcagcatggccagtccagggcacagaagcatctgcaggaagagcagctttcttcaagtcgctctttagccctttgtggttaatctctcagtactagttaataaatcttaatgaaactttccatgttcaagttcatgtgtgatttctgtctcctgattggatcctgactgatttgtatatatctacatatatatgtaagtatgtatgcatgcatgcttgtatatgtgtatttatgtgtgtacctatgtacaagtatatgttatgtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatgtttgtatatatgtgtataaatatgcgtatatttattaaatgtaagttaatcgggcttagctaa

SEQ ID NO: 327735 - DNA, 4362 bp, Homo sapiens
ggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtctagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtga

SEQ ID NO: 327736 - DNA, 2221 bp, Homo sapiens
  misc_feature (18)..(18): n is a, c, g, or t
  misc_feature (218)..(218): n is a, c, g, or t
  misc_feature (238)..(238): n is a, c, g, or t
  misc_feature (303)..(303): n is a, c, g, or t
  misc_feature (306)..(306): n is a, c, g, or t
  misc_feature (308)..(308): n is a, c, g, or t
  misc_feature (324)..(324): n is a, c, g, or t
  misc_feature (335)..(335): n is a, c, g, or t
  misc_feature (357)..(357): n is a, c, g, or t
tctaaacatcttgaaatntctctaaaaaacagaaacaacacaaaaacaaaaactgctgaaactgattttcttgctctagcccctacagctctcatccgtccgctcagcttccctgcggtctgtgctagccaccccaccaccctgctgactcagcctgggggcccgactttcacccacgctgctgctctggcctctgtgatctgccctcttgagccctnccctcccctcccctcccctncctcccagcccctcttctccgagtccagcccggggctctgtccgtgccactcttctcactgctgnggntnctcttggctcccttgnctaattctggntctgagaacaggctgctgcttnccagacctcttctggggacagacccccagctgcggacctggagacgcatggccttggccagtgcaggggcagggctgtgggtgctggtgacctggctctggtgcgtgcttggcagcaacttcacctcaccaagccttgctcttctgtgcaaaatgaaagtcatatttatcttgctaggttgttgtgaggatttgggttaagccatgtaaaatgctggtacagcattggcatctctaggtacccaatagatggtagcatggatgaggatgtttacggtgacaggaaataaatggtagcatggatgaggatgtttacggtgacaggaaataaatggtagcgtggatgaggatgtttacggcgacaggaaataaatggtagcgtggatgaggatgtttacggtgacaggaaataaatggtagcgtggatgaggatgtttacggtgacaggaaataaatggtagcgtggatgaggatgtttacggcgacaggaagtaacaatagtcctttgggtgtcttctccctgaagcttgctcctccatttggcccactgtgtgaacacccaccttcaccacgtccttcttgtttgctttcatccttcggtgtttttccctgttcagtctcgtcctgcagcacccttcacatcgtcgccacagccatcttcctaaagggcatgtgtgtccatggtcacaccaagcccgttcacaccaagatcgtgaacatgcctgatcacgtctgaagggcacgtgaccctgttctgaagtggcctgcagctcccgtggccctcagcaaagccaatggacgtgtactctgcttcctccaggaagccctccccccgctcccccctctggtagacacgtcttgtggttggtgtccacaaggaagttcctgattagcctcggagctgcccgatggcctctccactcctggcacatggcctgctggctggcctggggcagaactacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttat

SEQ ID NO: 327737 - DNA, 941 bp, Homo sapiens
tctttttagttaggtttatttattttgatgacaggaataatatctatttcaataaaataccgcggggctgaccatacaagaaatcaagcactagagaaagtcccgaggcagaggattcgtgctgaaggtggagcccttggctggaggggctgtcgctgaccagccagactccatgtcactggagtgggccagctgagcctctgctctgctgtggggagaagcggcgtccttgggtgtgtggctgagtttgcatctctgcagtctggggagcctgtgagtcgggggccggcctgggcagggcctcctctcgggggaaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttat

SEQ ID NO: 327738 - DNA, 399 bp, Homo sapiens
acctggtggttgcctaagtggattctggggaccatgttcagacacgcagtgagagtgtgtgttagctgtgcagactgacttaatccttagatctttttgcaggagttgagggcaagggctgtgtgctttgcctgtttcagaaggtggactctggcagctgtgtgaagtctaaagcttcgcttcgcttctcttttcagaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggc

SEQ ID NO: 327739 - DNA, 4539 bp, Homo sapiens
ggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttat

SEQ ID NO: 327740 - DNA, 4135 bp, Homo sapiens
ggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttat

SEQ ID NO: 327741 - DNA, 4901 bp, Homo sapiens
ggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtctagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatcctctcgtcctgcagcacccttcacatcgtcgccacagccatcttcctaaagggcatgtgtgtccatggtcacaccaagcccgttcacaccaagatcgtgaacatgcctgatcacgtctgaagggcacgtgaccctgttctgaagtggcctgcagctcccgtggccctcagcaaagccaatggacgtgtactctgcttcctccaggaagccctccccccgctcccccctctggtagacacgtcttgtggttggtgtccacaaggaagttcctgattagcctcggagctgcccgatggcctctccactcctggcacatggcctgctggctggcctggggcagaactacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttat

SEQ ID NO: 327742 - DNA, 1435 bp, Homo sapiens
tacgcgaaagctaacagaatctgcggtgctctgctggcgactggcaggacgcggtgcagagagcggacttccgcgacgcgggtttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattca

SEQ ID NO: 327743 - DNA, 1772 bp, Homo sapiens
tacgcgaaagctaacagaatctgcggtgctctgctggcgactggcaggacgcggtgcagagagcggacttccgcgacgcgggtttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattcaaaaaaacaaaaaaaaggccggccgccaagtcttctaccaccacgatggtcacctatggagccagggatacttgttcgatgggatctcgcctgggcaaaatgcattcctcctcaagtaaccggagaccttgcctggagcccacgacaagtgttggtccagtcatggttgcgaaaaggtaagagcctccctcaatgcaaaaatcgagtggctgcaacgcaggatgaaaactcggggtaaataggatccacacgaagaacgtgacacatatcgaactgtagacagaagagacaacaacgaaccattgcaactatcaattagacttatagataccatcacc

SEQ ID NO: 327744 - DNA, 1739 bp, Homo sapiens
ggaggccaaggcgggcagatcacctgaggttaggagttcaagatcagcctggccaacatggcgaaaccctgtctctattaaaaataccaaaattagctgggcatggtggcacgcgcctgtaataccagctactcaggaggctgaggcaggagagtcacttgaacccgggaggcggaggctgcagtgagtcgagatcgtgccactgcactccagcctgggcgacaagagcgagactctgtctcaaaaaaaaaagagtggttaacaagcatgatgatacaaccagttgaaagcaatatttgagttcataaagaagttgatgagttgataaaccaacaacacctaattggggaaagcataaggaagagagctgtgttgcaatcaaaaggtttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattca

SEQ ID NO: 327745 - DNA, 1808 bp, Homo sapiens
tggtggctgccggcccactgcggcgggagccctcgctccttttcccaccgtcgggacggtgcagagtggcagcttccctccgtggattccaggtcctgcctggcgagccgtccccaacgtctgcgttcctgagggaggcggccggggcagcgtgagctacaggcgatgtgcgcggcgggccgcagcccctggaggtcacggtgtgcgctggccgccgccgcggtctttgccccggtggcctttctgagctcctgggccgcgcccctgggaccaggcggaggccggggacggccccagggctggaggggagtcccgaaggccgctagcgacctgggtccaagccacgcccacggccaggcggggcgactgcgagctttgccgttgaaaggcggagcgtgtcttgtcgccttctagctgcaccttttgtggactgcagcatggaaccgtccaaggtgtttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattca

SEQ ID NO: 327746 - DNA, 1384 bp, Homo sapiens
tacgcgaaagctaacagaatctgcggtgctctgctggcgactggcaggacgcggtgcagagagcggacttccgcgacgcggaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattca

SEQ ID NO: 327747 - DNA, 645 bp, Homo sapiens
tcccttttttacaatgataatacatttttgttttaccttagtttaattgtctggcagtactcttaaaacccgcaattatttttctctgattctcttcatttatattgggtgctataatggatgtcttcaaaggctaaattatacaccttaaaaaccatacttcagcagctttcccccttcttttcagcttcatctcttttttcttctctactagatctttctcgacagcataccaacatgctattacttctcccatcttaaaaaaaaaaactcttttaatctactatacttttcatcttatcaccccatttccctctgtctctttagagcaaaaattcctcagaagaatagtccaagccgggcacagtggctcttgcttgtaatcccaacactttgggaggctgatgcgtatagattacctcagctcaggagttccagaccaatccaggcaacctggtgaaaccccatctctacaaaaaatacaaaaaacaaaaaaattagctgggcgtggtggtacatgcctgtaatcccggctactgtggatgctgaagtgggagaatcacttgagcctgggatgttgaggctgcagtgagccatgagcatgccactgcactccagcctgggcaacagagtgagaccttgtct

SEQ ID NO: 327748 - DNA, 1380 bp, Homo sapiens
atatatggtagccactgtgtggagcaagatgagtgagtcatggatcacatttggaaggggcaaccttcagattatggtggtgacactactaggaagacaggaagtggaggttgggttgcctgcttgtgtacctggtgatggtattgtacttcagaaaacaggtgagggaggtaaatggccatgaagggagaatatatctggtagcctagtttggcaggtgacataggcttccaaggaatgaatagacatgagatgcaagcagaagcataggagtagctgagggaagatgacactcagcctggaccttgtgctaattcgccactctgtggccacaccacgatattgagatgacttttgtggggcctggggtgtttcattcagcctggtggatatggaggcaaataaggtcaccttgtgagagtcactaggcccgagattgacggccaatgggtctaggctttgaatggagttaggtggacagaagaaagtcataatttctgaagataacaaatgcagcacagaagtggaatagggccatgaatacctgaaaacactaacgttcttttttcctgtggatttatgcatggagggcttcgtataatgacttggtactaccactgctattaggaaccattggaattctgtgataattttggattgctttttaattcaccaagactactgtggatgatgtcagccacattatggtgtgagccctaaatttaaggtcaatatcatgtgctaccttcatatctggtgatactagtattacctcaaatggtctgagtacaaatcccccttcccactctgctcttttgtataatgtgtcctagcctaactacccttttaatcaagaggactaagcagagttcctgtttattatttatttgtagcaagtttgaatttcatttctacacacagagttaattcaaacaagccagttacagctgggtgtggtgtcgcacacctatggtcccagccactcgggaggctgaggtaggaggatccctgaaacctggaaagttcaggctgcagtgagctgtaattgcaccactacgctccagcaggagtgacagagcgagaccctgtctcaaaaattaaaaacaagccagttgcatcctttcaagggaatcaggggctatcacaccttcttgattcagaaaagcttacataccacagtccctggttgctctctcttatgcatagtgcaacccccatgtggctatctgtggtgagtggtgtcctcttctctcaagttgtgagcatatttgattaattaactttcttgatgacttatgttcagcatcaggtgttgtgtgtttggccatcactataaccctagggtaagactcctacccttatcagtagaagaaaggggga

SEQ ID NO: 327749 - DNA, 644 bp, Homo sapiens
cttcaagagacaggatcatcccctctgggtgattctcaagagctgcagatgttcatgctcggtacattgaactacttacaagatctggagactattacaggttcttaagtgagatgctgaagagtttggaagatctgaaggcacaatgatatacatactggctgttgtggtgactatgaccccattgatgtgtgtgaaattggaagcaaggtatgtgcaagaggtgaaataattggcgtggaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttacaaggtataaggttcctgatggttaaccagaacaactgaggttgcgtctcacccgcagaatggcaagataaggactttgccattgatattattaaaagcactcatgaccattggaaagcattagtgactaagacaacgaatggcaaaggaatcagtagcatgaataccactttttctgagagcccctctcaagtgtgatcctgactcccgccagagtccacttgtggatgctatacgcaccatcctc

SEQ ID NO: 327750 - DNA, 8563 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327751 - DNA, 8714 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaagtgtttgtgttttaatttaatatgtttataagcatgtataaacatttagcatatttttatcataggtctaaaaatatttgtttactaaatacctgtgaagaaataccattaaaaaactatttggttctgaattcttactagaaggtggt

SEQ ID NO: 327752 - DNA, 6128 bp, Homo sapiens
  misc_feature (12)..(12): n is a, c, g, or t
tcatggtcctcntgataggtatgttcagcagagtttccagtcctgaggtgtatgaggccagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327753 - DNA, 6760 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327754 - DNA, 5399 bp, Homo sapiens
atgacaattggtggaaaccttaaaaggggaaacttagacaccccccctcaagcgcaggaccaagtgcagagtggactctttctggatgtggtagtcagacagggtgcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327755 - DNA, 2475 bp, Homo sapiens
tggtgtttgagtcctaaaaattgtataccagtgctaattgggatataccaaactttttgtctcttagtaattagttttgttttgttttgttttgttttaatgttgtgcttatcttaaggtgtaaatgcagacaaagttggaattgaagctgccgaaatgctattagcaaatcttagacatggtggtactgtggatgagtatctgcaagaccaggtaatgacacatttaggttaaaaaccctctaacctgttagatttgaatatgtggtagattgaatatcaatttaaataattgactttcagacactaattagcaagtcctacttcaataatttaaaaaaatattctgggatttgcattcctcaaatttcagccctcattttactttacctgtctacagtgttgggcgataacatccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327756 - DNA, 7574 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgcagcctctgtgcggcgcggccatctatgaaccccttccggatggcttcttcggtgcttatcctcccatgcacttccgggtcaacaagacctcccgtgaggtactggtcgacg

SEQ ID NO: 327757 - DNA, 6387 bp, Homo sapiens
  misc_feature (6380)..(6380): n is a, c, g, or t
  misc_feature (6383)..(6383): n is a, c, g, or t
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccagcagagggtcgacgcggccgcgaatttagtagtagtagncgnccgc

SEQ ID NO: 327758 - DNA, 757 bp, Homo sapiens
cttttggggtctttgctctttggggtctttgctcttttggggtctttgctcttttggggtctttgctcttttggggtctttgctcttttggggtctttgtttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327759 - DNA, 685 bp, Homo sapiens
  misc_feature (13)..(13): n is a, c, g, or t
  misc_feature (21)..(21): n is a, c, g, or t
tctacaggatctnctgacttnggacgctttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327760 - DNA, 3893 bp, Homo sapiens
  misc_feature (3886)..(3886): n is a, c, g, or t
  misc_feature (3889)..(3889): n is a, c, g, or t
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcagggcagagggtcgacgcggccgcgaatttagtagtagtagncgnccgc

SEQ ID NO: 327761 - DNA, 370 bp, Homo sapiens
aaaaaaaaaaaaaaaaaatacatgtaaaacccaaaaccacccaagaacccaagaaggcctgatctgtagtgtgaggatccagggcgcagctccgggggggggccgtggctggggggaggggcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327762 - DNA, 129 bp, Homo sapiens
tgaactttgcgccaattcaattaaggtatgttggtttcataaagaatgttggtatttcaccaagattattattaactgcatgacttgctgatttgttgtaaagcgtatacacttcctgaggatagcaat

SEQ ID NO: 327763 - DNA, 374 bp, Homo sapiens
gtattcacaaatacttgatcacagcttcactgtttctcaaattattcatcacattattatctcatctgaactgtgctctttctgcttaaatagatgcttatagaaaatctaatttttctttttattgctctactacttcctgtcataatccaggtaactgctttaaaataatttcaatgctgtgtgccctgctgttctttaattgcatcaaatgctgatctctgggtagcctgtgtttggccctgcttttaagaacactaatacatgtataacttcctccgaatgttccattctacttcttagaagttagctcttatttagtgagctatgacatacatttgtaatgaaaattttcttaaatagaagccatacta

SEQ ID NO: 327764 - DNA, 503 bp, Homo sapiens
ccactggccgtggacctctcttgcaagtaagtcatccaagttcccaaagccacgcatgcacgcatgaatgtgagggcagaggaagagggcaggtgtttatacctgaagcttagacacacgatgccttgccataataaacaccttctaaaaaaaggaaccttgtgaaggtcaccttcactttgtcttgcaattttatgttgaatagacagtcgttattgaagaataaaagggaatatctggccgggtgtggtggcttatgcctgtaatcccagcacttggggagaccgaggtgggcggatcacctgaggttaggagtttgagaccagcctgaccaacatggagaaactctgtctctactaaaaatataaaattagccaggtgtggtggtacatgcctgtaatcccagctactcgggaggttgaggcaggagaattgcttgaacctgggagggggaggttgcagtgagctgagatcgtgccactgcactccagcctgggcaacga

SEQ ID NO: 327765 - DNA, 8820 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacaggtcggcttgggacatctttctctttgtatcaaccatccataccattttaaaaagaaaggagtttgcataaaactggtttcagaaccatttctctgaatgctatatagccagtgttcttcgtgcactaaattttcagaattgattctgaaattcaaaggaagaaggtatacttttaggtagtatggatgttttttgaggcctagcaccttgatacctaggtattctctgatttttgtggccctaacttctttttacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327766 - DNA, 6268 bp, Homo sapiens
tctccatgactggcaccacgatcggcagagcgggaacgggtgactgcttgcgcctcttcactctggcagggcggatgtgctgcaccttgacaggcctggtggcctcactggagctgccgtcttaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327767 - DNA, 8311 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327768 - DNA, 5382 bp, Homo sapiens
actctagagtaaaaaacgagcgcgagtcaagctgtacagatattggtcggtatccctactgcactcaactccttagtgcaacctgcatgcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327769 - DNA, 3850 bp, Homo sapiens
agcaggacagacggtcaggctgcgagagcgcggcagtaggagcatgactctctgagactgaaaacccctctggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 327770 - DNA, 6878 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcattattgcagccctagcagcactccgcctcctattcttgcacgaaacgggatctactaccccctaggaatcacctcccattccgataaaatcaccttccacccttactacacaatcaaagacgccctcggcttacctctctccttc

SEQ ID NO: 327771 - DNA, 5156 bp, Homo sapiens
cagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatctatggccagtgtttatcgaattcagagccagcggctcaccatactgggtcgccactcgggcagatcgctcagtgcatgtagtctcgtactggagccg

SEQ ID NO: 327772 - DNA, 225 bp, Homo sapiens
tccctgatgttacctcaaatgccacaggttaaggccaccagcccctactaggctgccctcgctttagacacacctgcaggcttgggtgtcctcagaccacatgtacttctcaccaactggctgcaaatttggaggttcccaccatgccctcaagttcgataactcactaaaacaattcacagaatgcagaaaagcatgatactttctttctcttttttttttttt

SEQ ID NO: 327773 - DNA, 389 bp, Homo sapiens
ttttttttttttgacagggacttattctgttgcccaggctggagtgcagtggtgtgatcacagctcactgcagatttcacctcctgggctcaagccatcctcccacctcagcctcccaagtagctgggaccacagatgtgtgccaccatgaccagctaatttttaaatgtttggtagagacagggtctctcaatgttgcccaggctggtctcaaactcctgggctcaagccatcctcctacctcagcttcccaaggtgctgggattacaggcgtgaaccactgtgcccagtcacacagatttttttaaaactcaccaaagtaaatcttataataaatcctttgggactatttaaataataataataactattatttacattggaggttt

SEQ ID NO: 327774 - DNA, 1528 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327775 - DNA, 473 bp, Homo sapiens
ccaagtttgtagtctgtgtagcagggtggatggtgcccttcactaaagtaaagacgacagtggagaacatgtttgggttacataagcctccttgatgttggtgggttcaggtgggacatttgaaatgcctatgaagtcaggagggaattgaatatcctgatttgtttttattcactagttaaagcttgaaaaattttccttttttgacattaaatcttgttgttgttttaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327776 - DNA, 462 bp, Homo sapiens
gaattcatggcagaccaggtcaaaaagtaaattccaaatgtcttttccagggtcaggacaatgtacaattgcttgaattccatcatcccctgtagtaagcagttgtaaaatgggcatgtaaacatcaagccattttggattttcagaacggacttgtttggcatttatgcctcccagactgagcaagagtatctaaagatagaaaaaggcattaccaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327777 - DNA, 546 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagattttcctgtcaacgggaccaatatcactgatggggaaatgaggcaacttgaaagctaggagtcaagttcaactgctttctcctttatcctcacactggattattttgctttcaccttgagagtcttcctcagcttcatccttttccatgcctgagggccctcctcc

SEQ ID NO: 327778 - DNA, 2392 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgacaaaaaaaaaaaaaaaaaaaaaaaaaaaaaggggggggggtaaaaagtttccccgagaggggcgcccaaggttaacggcggtacccaggttttttgggcacaaggggggccccatataggggaggcggaataaaaaggcaagggcaggggcgcgggcggttaacacaagggcgggagccgggggaaacgtggcttacctgggggaacacctggggggagagcgaacctcttaatttccggggcgggcgcggggaaccatcatcgggcgccaatttacccctaagcggaaatttcagagaacctaagggcgacactcttacacactctctcaaggcgtcttcacgggtgtctcacccctagagggaatatatggctcaggggggggtggagaacaatttccggggccaccaggggagtatgtgagtctctggcaacaaatttttataggcggggtctgtcaatactacatatatacaaaactaaattacaatataatcagaaacacacactaaaaaacattaacagactagatacatataaaaatttaaatagataaatatggagagaacgaagaaacgaggagatgacgaaaggagaaacaaaaaaacagatataaaaccaacaaaccaccgaggaagagagacgagacaaaaacagcgaaccacgcagagagagtgaaaataccaacaacaaagacagataatgagaggacaaagaggagctacctaaaatagacaagcacgagagcgaaacgccacgagtagaatagcacgagaaaacactacggacagtaaaacagcgaaggcgaagaaatgaacaaagagaagcaagagacgagacgcaggccgcccacactatacaaacgg

SEQ ID NO: 327779 - DNA, 1753 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggaaccttatgcaaaaatccagatgtaatgaggtggctcctttcacccttcacgtggtctgccaggaagttgcctacttgctaaaaggtgtaccctgagcatttgtgactccgagggaaaccaggaacatcatgctgcagaaaccctttggaggaacgtgccaactgctccgtaaccatgagctggctctcctttgatggagagattaatagtttccataattatatcatcctggttgttctggggccagagtttacttagacttgaaagaaattgaagttaattgaaaaagaa

SEQ ID NO: 327780 - DNA, 1331 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327781 - DNA, 1499 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327782 - DNA, 497 bp, Homo sapiens
acagcacgcgctacatctggatgagtccgctgaggacgccgaatagccagtgtttgctgtagaccgtgctccctatgcagtctccaccggccacctcctcctcctcctccttgtcgcgacccggcggcggcggcaaggggttgcgacaaagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327783 - DNA, 521 bp, Homo sapiens
  misc_feature (27)..(27): n is a, c, g, or t
atacggctaggtacgaggctgggtgtngtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327784 - DNA, 530 bp, Homo sapiens
atattaagccaaaatcagattcttgggaatagtcagtaggtttttatggttcttcaaatgacatcacatttcctaccattagaatcagatttcaaaataggaactttttcaggaaaatgaaggacagaatgtgggaacagactgtaaagaagaggcggggggagaagtactagctcaagagtaaaacggaatgggaaagcatagtcatttccttgagaatgatttagaagactgcttaggaagtactgttactatcatctggagatctgccagcatttcttttccattggaccatttagaaaccacaggtagagcaatcagtaccttaaagcacgtttttctcttctgtgtttgatttttgtttgtttgtttgactcacaggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327785 - DNA, 517 bp, Homo sapiens
attgttgccatttccatgatgttcaatattcaaagcaatttggagacttcttgttccagatgcacccctttgttcgttgctcacatcaagtgatatctgactggtctttaaagatccaaatttcacaattttggatgagccttgactgatctgaaaatgttagatttttctctttcattctgtttgaacatgctttagtgtgagttggctatttctttagagcaattaaggaaaaatgcccaatttcccagaacaactcacaaagtactcatggattatttcattttcttaggaagttgcctacttgctaaaaggtgtaccctgagcatttgtgactccgagggaaaccaggaacatcatgctgcagaaaccctttggaggaacgtgccaactgctccgtaaccatgagctggctctcctttgatggagagattaatagtttccataattatatcatcctggttgttctggggccagagtttacttagacttgaaagaaattgaagttaattgaaaa

SEQ ID NO: 327786 - DNA, 1658 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgacaaaaaaaacaaaaaaaattggggcccgcccggaagtttacactcgggggggcaggaggaagcacgtcagaccggcgaagggttccaaaaccggcgggggaacaggtgtggtatgcagccccgtccccggta

SEQ ID NO: 327787 - DNA, 1539 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaagggtttcaggtctttaaatccctgaaattttgggatttctttcttgttccaggttgtttaaaccttttattttttcctcc

SEQ ID NO: 327788 - DNA, 2370 bp, Homo sapiens
cagcggagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgacaaaaaaaaaaaaaaaaaaaaaaaaaaaaaggggggggggtaaaaagtttccccgagaggggcgcccaaggttaacggcggtacccaggttttttgggcacaaggggggccccatataggggaggcggaataaaaaggcaagggcaggggcgcgggcggttaacacaagggcgggagccgggggaaacgtggcttacctgggggaacacctggggggagagcgaacctcttaatttccggggcgggcgcggggaaccatcatcgggcgccaatttacccctaagcggaaatttcagagaacctaagggcgacactcttacacactctctcaaggcgtcttcacgggtgtctcacccctagagggaatatatggctcaggggggggtggagaacaatttccggggccaccaggggagtatgtgagtctctggcaacaaatttttataggcggggtctgtcaatactacatatatacaaaactaaattacaatataatcagaaacacacactaaaaaacattaacagactagatacatataaaaatttaaatagataaatatggagagaacgaagaaacgaggagatgacgaaaggagaaacaaaaaaacagatataaaaccaacaaaccaccgaggaagagagacgagacaaaaacagcgaaccacgcagagagagtgaaaataccaacaacaaagacagataatgagaggacaaagaggagctacctaaaatagacaagcacgagagcgaaacgccacgagtagaatagcacgagaaaacactacggacagtaaaacagcgaaggcgaagaaatgaacaaagagaagcaagagacgagacgcaggccgcccacactatacaaacgg

SEQ ID NO: 327789 - DNA, 1511 bp, Homo sapiens
  misc_feature (27)..(27): n is a, c, g, or t
atacggctaggtacgaggctgggtgtngtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327790 - DNA, 1397 bp, Homo sapiens
  misc_feature (27)..(27): n is a, c, g, or t
atacggctaggtacgaggctgggtgtngtcatggaccgcaacccctcgccgccgccgccgggtcgcgacaaggaggaggaggaggaggtggccggtggagactgcatagggagcacggtctacagcaaacactggctcttcggcgtcctcagcggactcatccaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 327791 - DNA, 203 bp, Homo sapiens
  misc_feature (6)..(6): n is a, c, g, or t
  misc_feature (11)..(11): n is a, c, g, or t
gcggcngcctnctactactactactgctcgaattcaagcttctaacgatgtacggggacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaag

SEQ ID NO: 327792 - DNA, 678 bp, Homo sapiens
tcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327793 - DNA, 873 bp, Homo sapiens
gcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgccaaactgccttttaccatttccattgctttttattacttaatctcccaactttgtgcctggtgtctttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactaccacgccatgtctcaccagtc

SEQ ID NO: 327794 - DNA, 572 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327795 - DNA, 539 bp, Homo sapiens
  misc_feature (16)..(17): n is a, c, g, or t
ggatccccgggctgcnngaattcggcacgaggatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327796 - DNA, 597 bp, Homo sapiens
ggcacatatactaaaattggaacgatacagagaagattagcatggcccctgcgcaaggatgacacgcaaattcgtgaagcgttccatatgatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327797 - DNA, 735 bp, Homo sapiens
  misc_feature (3)..(4): n is a, c, g, or t
  misc_feature (16)..(16): n is a, c, g, or t
  misc_feature (21)..(21): n is a, c, g, or t
tgnntagtacgaggcngggtntgaatcggccgagctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcatgttgaacacaacaaacacaaaaaaaactccgggggctctctatgccggggggcggccacacgccggtctcggactggcgcccgtggccataagctggttcccttgaccaagtttctttgtccacgtgggtaatcggcgggtccctatagggagccgctattcgaagccggtacgtgatccgcccca

SEQ ID NO: 327798 - DNA, 525 bp, Homo sapiens
  misc_feature (3)..(4): n is a, c, g, or t
  misc_feature (16)..(16): n is a, c, g, or t
  misc_feature (21)..(21): n is a, c, g, or t
tgnntagtacgaggcngggtntgaatcggccgagctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327799 - DNA, 651 bp, Homo sapiens
  misc_feature (3)..(4): n is a, c, g, or t
  misc_feature (16)..(16): n is a, c, g, or t
  misc_feature (21)..(21): n is a, c, g, or t
tgnntagtacgaggcngggtntgaatcggccgagctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcctcgagggggggccccgtaacccatttccccctataaggaggtcgttttacaatttcactggcccgtcggttttacaacgtcctggaactgggaaaaaaccctggccgtacccccaactttaattc

SEQ ID NO: 327800 - DNA, 536 bp, Homo sapiens
  misc_feature (6)..(6): n is a, c, g, or t
  misc_feature (507)..(507): n is a, c, g, or t
  misc_feature (518)..(518): n is a, c, g, or t
  misc_feature (525)..(525): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagattggatcacagccgaaggagtaaaggcggggnggaaatgaaanaggtaanagtcgattgat

SEQ ID NO: 327801 - DNA, 218 bp, Homo sapiens
catcagctcccccctgttatcgagtgctttcatgccgggaaggcgacagtgcctaagacagaaattcgggaaaaactagccaaaatgtacaagaccacaccggatgtcatctttgtatttggattcagaactcattttggtggtggcaagacaactggctttggcatgaaaggcactggacatgaagtgggatcctcatagagtctgacctcgcaggg

SEQ ID NO: 327802 - DNA, 507 bp, Homo sapiens
  misc_feature (6)..(6): n is a, c, g, or t
  misc_feature (11)..(11): n is a, c, g, or t
gcggcngcctnctactactactactgctcgaattcaagcttctaacgatgtacggggacatggcctgtatgagaagaaaaagacctcaagaaagcaacgaaaggaacgcaagaacagaatgaagaaagtcagggggactgcaaaggccaatgttggtgctggcaaaaagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaa

SEQ ID NO: 327803 - DNA, 1473 bp, Homo sapiens
ttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacagccgaaggagtaaaggtgctgcaatgatgttagctgtggccactgtggatttttcgcaagaacattaataaactaaaaacttc

SEQ ID NO: 327804 - DNA, 1861 bp, Homo sapiens
ttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcaagccgaaggagtaaaggtgctgcaatgatgttagctgtggccactgtggatttttcgcaagaacattaataaactaaaaacttc

SEQ ID NO: 327805 - DNA, 139 bp, Homo sapiens
ttggatccggttggatccgaattcggatccaacgccaatgttggtgctggcaaaaagccgaaggagtaaaggtgctgcaatgatgttagctgtggccactgtggatttttcgcaagaacattaataaactaaaaacttc

SEQ ID NO: 327806 - DNA, 190 bp, Homo sapiens
  misc_feature (29)..(30): n is a, c, g, or t
  misc_feature (37)..(37): n is a, c, g, or t
cgcggccgcgcgacacggtgcgagaagannacagaangaagaaagtcagggggactgcaaaggccaatgttggtgctggcaaaaaagtgagctggagattggatcaagccgaaggagtaaaggtgctgcaatgatgttagctgtggccactgtggatttttcgcaagaacattaataaactaaaaacttc

SEQ ID NO: 327807 - DNA, 903 bp, Homo sapiens
  misc_feature (742)..(742): n is a, c, g, or t
  misc_feature (745)..(745): n is a, c, g, or t
  misc_feature (749)..(750): n is a, c, g, or t
  misc_feature (752)..(752): n is a, c, g, or t
  misc_feature (760)..(760): n is a, c, g, or t
  misc_feature (778)..(778): n is a, c, g, or t
  misc_feature (807)..(807): n is a, c, g, or t
  misc_feature (809)..(809): n is a, c, g, or t
  misc_feature (811)..(812): n is a, c, g, or t
  misc_feature (817)..(817): n is a, c, g, or t
  misc_feature (819)..(819): n is a, c, g, or t
  misc_feature (821)..(821): n is a, c, g, or t
  misc_feature (834)..(834): n is a, c, g, or t
  misc_feature (838)..(838): n is a, c, g, or t
  misc_feature (840)..(840): n is a, c, g, or t
  misc_feature (849)..(849): n is a, c, g, or t
  misc_feature (853)..(853): n is a, c, g, or t
  misc_feature (866)..(866): n is a, c, g, or t
tcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttccaaaaaaaaaaaaaaaaaaaaaaacaaaactttgtgggcgcgctcgggccccgaaaaagttttnaanaccnntncgttgggnccgggcccatggtagganccggcccaacgggcccaaggaacccggcngnanngggcngntncccccaataaaangccngnggaccggcngtcngacaacccagggnccggggcctcggccatcccagggcccagggccgatta

SEQ ID NO: 327808 - DNA, 759 bp, Homo sapiens
gtcaaaggctgtgaggtgagtcacaaggaaggcactcctcagttccctggaaataatcctgctgttgttattgttattgttatattaatgttggctatcctttgccatacctactgagtgttgaaaatatccatttagcagacttcttggacagggattagcagccttattttacagatgatggaattgaggcacagagatataaagaaacatactaaaaagcatagggaatgggtaacagagttgggttccaagccaggcttttgtggctccagagcctgtggtctacaaaatatgggatctgtaagaaaggaaagtcagggggactgcaaaggccaatgttggtgctggcaaaaagtgagctggagattggatcaagccgaaggagtaaaggtgctgcaatgatgttagctgtggccactgtggatttttcgcaagaacattaataaactaaaaacttcaaaaaaaaaaacttgtgtgtggggcgcgcccttgggcccctgaaaaaagcttttttaaaccaattggtggggcgcgggggcccattgggttaaggacacacggggccatagggggtccccaagagaaaccgggcggcagagaaaaaagggcgtgagattctcccgaccgcatgtaaaaagcgcccgggggggaaacggaggcgttcggaaaaaatctcgaagagggagctccagagaggcacatcggggagcatattaaaaggggaggcccagaggagcctcggatataaagttaccc

SEQ ID NO: 327809 - DNA, 163 bp, Homo sapiens
  misc_feature (22)..(22): n is a, c, g, or t
agcgacgctgatgctgcggtgnctctagaggatcccggcaccattgtgtggcaaaagaagtgagctggagattggatcaagccgaaggagtaaaggtgctgcaatgatgttagctgtggccactgtggatttttcgcaagaacattaataaactaaaaacttc

SEQ ID NO: 327810 - DNA, 130 bp, Homo sapiens
  misc_feature (12)..(13): n is a, c, g, or t
catgctgcggtnnctctagaggaccccggcaccatgtgctggcaaaagccgaaggagtaaaggtgctgcaatgatgttagctgtggccactgtggatttttcgcaagaacattaataaactaaaaacttc

SEQ ID NO: 327811 - DNA, 361 bp, Homo sapiens
  misc_feature (91)..(91): n is a, c, g, or t
  misc_feature (101)..(101): n is a, c, g, or t
tgggagagtggaggtaagagaaaggaaggagtgtcagaataatagagggaaaaaggtgagaaaagaaacctagtaaagaagtaggcacganagacaactgnctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327812 - DNA, 168 bp, Homo sapiens
  misc_feature (29)..(30): n is a, c, g, or t
  misc_feature (37)..(37): n is a, c, g, or t
cgcggccgcgcgacacggtgcgagaagannacagaangaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327813 - DNA, 803 bp, Homo sapiens
aacctgtggatactcattaattctttgttaatatttatttccatgatagcatcattccagccagacttgctgaaaatctactggtgaggcaaatataatatatataaatatgctacatatatatttataaaatttctagtgggagttctatataaatgtttcttgggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaagacctcaagaaagcaacgaaaggaacgcaagaacagaatgaagaaagtcagggggactgcaaaggccaatgttggtgctggcaaaaccgaaggagtaaaggtgctgcaatgatgttagctgtggcactgtggatttttccgcaagacgcataaaattaaactaaaggactccagaaaagaaaagcagaataaacgaaaaacaaacaaaccttgtgcgtgggcgggcacttggccccctgagagaagaggtttcaaagaccacactctggtgtgggggccggggggccccaggtaagtctacggtgccagcgggccgaaaaggggtccccaagcaaaaccgcggccaaagcaggcggttggtctctccccaataaaaaccgcgggggaaccgggggttggacaccccaaagcgctgcgggcaactcggcctaacaaggggccagaggcgaaatag

SEQ ID NO: 327814 - DNA, 528 bp, Homo sapiens
ggacgcgtgggtcggacgcgtgggtcgacccacgcgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327815 - DNA, 382 bp, Homo sapiens
gcggactactactactactaaattcgcggccgcgtcgcacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaaagtgagctggagattggatcaagccgaaggagtaaaggtgctgcaatgatgttagctgtggccactgtggatttttcgcaagaacattaataaactaaaaacttc

SEQ ID NO: 327816 - DNA, 538 bp, Homo sapiens
tcgggacaccgaagtggaagcaatcccgcacagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagattggatcaagccgaaggagtaaaggtgctgcaatgatgttagctgtggccactgtggatttttcgcaagaacattaataaactaaaaacttc

SEQ ID NO: 327817 - DNA, 811 bp, Homo sapiens
  misc_feature (29)..(30): n is a, c, g, or t
  misc_feature (37)..(37): n is a, c, g, or t
  misc_feature (170)..(170): n is a, c, g, or t
  misc_feature (172)..(173): n is a, c, g, or t
  misc_feature (175)..(175): n is a, c, g, or t
  misc_feature (178)..(180): n is a, c, g, or t
  misc_feature (182)..(182): n is a, c, g, or t
  misc_feature (190)..(190): n is a, c, g, or t
cgcggccgcgcgacacggtgcgagaagannacagaangaagaaagtcagggggactgcaaaggccaatgttggtgctggcaaaaagccgaaggagtaaaggtgctgcaatgatgttagctgtggccactgtggatttttcgcaagaacattaataaactaaaaacttcanannanaannnanaaaaaaanaaaaaaaaaagaaaaaaaaaaaaagaaaaaaaaaaaaaaaaaaaaaaaaagagagaggggggggcgcgccccaacagaaatatatccccgcgggggggcgccccaaaatagcgcgcgaccccaccacgttttttctacgaaacaaaggggcgcccacaaagaggggagtttattatatataaaaagagagagagaagagagggggcggaggatttataaaacagaaggttttaaggaggaaaaaaaacgggcaagaggagatatctttttagaaaaagaacaacccatttttggagggggggggaggaaacaacatagggaggcgccacactctccccaccacaagaataatttataaacgccttcgcggggagaggcataatatctacaacacctgagagcgacgcggtacaacagagaggggtgaaccacccaccacacagcgcgcactatcgttcgcacgcaccaggagagaatagacaaccgtcttctcgctcggccgcgagcgcaggagtcatgtttctctcgctatcacagagcaatttttacccaccggggggccgcaaggagatgcccaacatcacatgacacccggaacggaggggggagggcacaggctgg

SEQ ID NO: 327818 - DNA, 958 bp, Homo sapiens
  misc_feature (29)..(30): n is a, c, g, or t
  misc_feature (37)..(37): n is a, c, g, or t
cgcggccgcgcgacacggtgcgagaagannacagaangaagaaagtcagggggactgcaaaggccaatgttggtgctggcaaaaaagtgagctggagattggatcaagccgaaggagtaaaggtgctgcaatgatgttagctgtggccactgtggatttttcgcaagaacattaataaactaaaaacttctgtgaaaaaaaaaacacacacacaaaaaaaaacataacatatgtgtcacgggacgtcctgcaagccccatagaaaaactttcatagtacaccaactactctcagtagaggcgacgcggggcaccagaagataaaggtgtgacacaatgggcctacactacggtggttgttaccaacacgtggatatctgtgtgcccaatacgaccatctcagaggctgcgaggactccagaaaacaaaacaaaaaacagccgccccgacagccggccaaaacccgagcggggtaccgaagaaaaaaaaaaacaccccgcacgagaggagacgacccaccgcaggcgaccaaacacacaaaagggagaacactacgagcccacagaggggaggccccaacacgagcagaccgaggcaccacaaaacacacgaaatatacatagcaatccacaacccgcttcatcaacataaccgacatcaaaaactagctaactagaatcacaaacacactcctcactaactcaccaacattacacacaacaacactcccaacaactatatcggcccctggtctagtgagcacgatgaactgcgtctgacatggcaggtgctggcgaggttctgggttgctgccggagtgggtggtggaggaggtcgatgtcgggtctccgtaggcagaagggggacgacggagttgacatggaggctgggtgacattcgatcgcgagagagaaggtagtgagatacgatgcccgcacatgctgtagggggcgaaggtg

SEQ ID NO: 327819 - DNA, 391 bp, Homo sapiens
  misc_feature (313)..(313): n is a, c, g, or t
gcggccgcctactactactactactaaattcgcggccgctcgacccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagatnggatcacagccgaaggagcaaaggagaagctaaatccctaaggacgcagccccataatgggccccagtgtggagagag

SEQ ID NO: 327820 - DNA, 203 bp, Homo sapiens
ggatttgctggtgcagtacaactaggcttaatagggacatggcctgtatgagaagaaaaagacctcaagaaagcaacgaaaggaacgcaagaacagaatgaagaaagtcagggggactgcaaaggccaatgttggtgctggcaaaagtgagctgagattgatcacagccaagagtaagtgctgcatttcgtggccattactcg

SEQ ID NO: 327821 - DNA, 711 bp, Homo sapiens
  misc_feature (599)..(599): n is a, c, g, or t
ggtacccctacacggtgaaaaaggggaggcaaaaggttatccccgggtacctgaaagatttcccagggtaagatatcgaaaggggatagattggtggcctcacgcgtgtatccccagcactttgggaggcaagaggatagcttgagctgaggagttcgagaccactcgtgccgaattcggcacgatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattngatcacagccgaaggagtaaaggtgctgcaatgatgttagctgtggccagtgcatattagtggacagcacttagtagctgtggaggaagatgcagagccagtgtggagagag

SEQ ID NO: 327822 - DNA, 270 bp, Homo sapiens
gcacctttactgcttcggcttttagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccagtgcatattagtggacagcacttagtagctgtggaggaagatgcagagccagtgtggagagag

SEQ ID NO: 327823 - DNA, 436 bp, Homo sapiens
gcacattgacgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagattggatcacagccgaaggagtaaaggtgctgcaatgatgttagctgtgggggctgctgaggtggaacctgatgctgcagcgcctgtgacgtctgactcaagtgt

SEQ ID NO: 327824 - DNA, 748 bp, Homo sapiens
taggctaggtaagagcccggtgttatgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgcacaatgtgatgcttggatgattgtgatcaagccgaaggagtaaaggtgctgcaatgatgttagctgtggccactgtggatttttcgcaagaacattaataaactaaaaacttcacacacaaccagcacaaaccaaaaccaacaaaacgaaacacagacacaaactatttccgtaggactcacagcacagagctgcgcatacactacagcggatcatcaacagcgcgctcgccttgtccgtcattatatctcctgcaccctcatgtgttgccaacagtgggaaaaccgtgcatacacacaaaagaagcgtaaaca

SEQ ID NO: 327825 - DNA, 166 bp, Homo sapiens
cggccgctactactactaaattcgcggcccgtcgactgtctgaagacctcaagaaagcaacgaaaggaacgcaagaacagaatgaagaaagtcagggggactgcaaaggccaatgttggtgctggcaaaatgagctggagattggatcacagccgaaggagtaaag

SEQ ID NO: 327826 - DNA, 282 bp, Homo sapiens
gaggtgatacccctagttttagaagtctcatagctcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaaggtgctgcaatgatgttagctgtg

SEQ ID NO: 327827 - DNA, 941 bp, Homo sapiens
tcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagatgggatcaaagcgaaggagtaaaggtgctgcatgatgttagtgtggcactgtggatttttcgcagacattaataattaaaattgaaaaaaaaaaaaaaaattgttcgggcggccggcccaaaaggttctcaacacccattcggtggcgcgggccaagaggatgacttggccacgcggcccaaggaacgggccgacggcccgttccccaaaaacgccgggccggggtcgacaaccccgggtcggggtccgcttccagggccacgcgacccccgccctcgctcgcgggcacaatagaaacgagaaaaagagccaacacaaagagcacagcacagaca

SEQ ID NO: 327828 - DNA, 290 bp, Homo sapiens
  misc_feature (254)..(254): n is a, c, g, or t
ctactactactaaattagcggccggtcgaccaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaanataactcgccctcgtcggacgggtgagttggcttat

SEQ ID NO: 327829 - DNA, 462 bp, Homo sapiens
ctatatgcttagacctgagtaaccttaagcatttatggaattctacaagcagagtacagggtcagaatgtatctggggagtctgttagctctaattaagttgctgttcttcatgcaaaagtacaagagattcaatgaagaatttcaaacagataaataataaatgataaaatatactacttttgaaagttacagtgtgaaaaagtacatataaagaacatgaatccaacaaaaaaaattgggataataattagtttccctaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaaggtgctgcaatgatgttagctgtg

SEQ ID NO: 327830 - DNA, 400 bp, Homo sapiens
  misc_feature (2)..(2): n is a, c, g, or t
anagagagagagagagagagagagagagagagagagagagagagagagagagagagagagagagagagagagagagacacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327831 - DNA, 511 bp, Homo sapiens
atgcgcgacgcttccatcaatgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaaggtgctgcaatgatgttagctgtg

SEQ ID NO: 327832 - DNA, 549 bp, Homo sapiens
ggaaagagagagaggcagagagacaaagagggagtcaaagagagaaagagagagacagagtcagagagagaagcagtaaagagaaaaacagtgtaccctgttcctttaaaagccagggtaaatttaaatttaaaacctctaattgataattgaaggtcttctctgtgaccctgtaacactccaataccaccttgttgtcactgtaaacaaggtggcatcgataaacaccccaccaccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaaggtgctgcaatgatgttagctgtg

SEQ ID NO: 327833 - DNA, 1113 bp, Homo sapiens
gggtttatcggaaaatgtgtttattgagatggtttcccactcatcttgactcagagtgcttttagtgctgcttcctcctgaaggaacatccttctgtaagcctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttctgtgtctggttgtttgaaaaaaaaaaaaaaaaaaaaaaaattgggggcacaaatgccggggtggcgagaaaaagagcgtcacggaatggggccaaggggccactaggtggtacatggaccccagtttcttggtaccaaagggggaacatctggcgcgacacccatatagaagagtcggcactaaattccgataagccagggtaacccggaattactgcactcgcgcgccaaaaagaacacacagagccgcaagacgagacgcgcgaaagaacgcgacaaaaacgaacaaagaggggggaaaacaagaaagaaacaagaaaaagaagagaggcagagaaaaggaaaacaaacaaggacaaaaaccaaaacgacaacaaacgacggaacaacaacacaggaagacgaaaaaaagacaaaaacaacgaaaaagacaaaaagcaaaaacaaaaaagacaaagagaaaaacaaagagaaaaaaacaaagaaaagacaaacaagaaa

SEQ ID NO: 327834 - DNA, 1005 bp, Homo sapiens
ggacgcgtgggtcggacgcgtgggtcgacccacgcgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttctgtgcaacgccaacacacaccgacacaaacaacaaaaaaaacgcgcaaacaaccacaagaagcaaaccagaaaaaagacgaaaaaacaaagagaaaagaaaaagaaaaaaacaaaaaacaaaaaacacaaaaacagaaggcggcagcgagacaaaaaacaaacagcagcagagagagagagaaaaagacgcgagcaggcagagacgaacagagagaaacttgagaaacgaaaaaagaaagaggagagacaacaacagcagacaagaccaacacgcagcagacgaagagaaacaaaatgtggggagaaaaaaaaccaacacacaagcacgcggagcaaaacagaaaggtgagaaggcacagacgaagcgagagaaacaggaagaaaaaacagaagagaaaagaaagaaaaggcaggcagaagggaggcgaaagcccggaaaacagaaacacaaaaaggaacagaaaaacagcgcacac

SEQ ID NO: 327835 - DNA, 537 bp, Homo sapiens
ccaatacacgagcacccagattcataaagcaagtccttagggacctacaaagagacttaggctcccacacaataataatgggagactttaacaccccactgtcaacattagacagatcaacaagacagaaagttaacaaggatatccaggaactcaactcagctctgcaccaagcagacctaacaggtggcatcgataaacaccgtgtttatcgatgccaccaccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaaggtgctgcaatgatgttagctgtg

SEQ ID NO: 327836 - DNA, 348 bp, Homo sapiens
gcgagcctgtaaaatatcagaaatagaaagtcatgaccaaccgactacttcagaggaaacaaatggtcattgatgtccttcaccccgggaaggcgacagtgcctaagacagaaattcgggaaaaactagccaaaatgtacaagaccacaccggatgtcatcttgagaatggacaccagttaaacagaccagcaaatacgcgtgcggaacaggacccaggcgtctcctcttgctccctggttggggggcggtggctggggctgtgcggccaatgatggatttgtttcttttatgttttaaaataggatttagtgttgtgacctgtttttaaaataaagtatcttgaaat

SEQ ID NO: 327837 - DNA, 553 bp, Homo sapiens
cactcgagctcgctaccctgctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327838 - DNA, 558 bp, Homo sapiens
tacaccctgttccagcctaaaaatcctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327839 - DNA, 535 bp, Homo sapiens
gctactactactactaaattagcggccgatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327840 - DNA, 952 bp, Homo sapiens
  misc_feature (952)..(952): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaaaaaaaaaaacaaacaaaaaaaaaaaaaacaaaaaaaaaaaaaaaaaaaaaaaaaaaaaaaaaaaaaaagggggggggaaaaaaacaaggggggggggaaaaagggcgagtggaaagggactactagtggattagtaaaagaagcggaggcagaacaacaccagggggcgacaaacaaagacgacagccagacgaaacccagcggggggccaacgacacgcgggaaaaggccgcaaaaatacgggcgagaacgattggtggaaaatattgtgttgaatgaagccgcatacacgacaacagaagagagacgacaggaacatagagggtgaaagagtacgcaatcgagcaaacaggacgacagcgcaaatcctcacgccn

SEQ ID NO: 327841 - DNA, 919 bp, Homo sapiens
  misc_feature (16)..(17): n is a, c, g, or t
  misc_feature (919)..(919): n is a, c, g, or t
ggatccccgggctgcnngaattcggcacgaggatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaaaaaaaaaaacaaacaaaaaaaaaaaaaacaaaaaaaaaaaaaaaaaaaaaaaaaaaaaaaaaaaaaaagggggggggaaaaaaacaaggggggggggaaaaagggcgagtggaaagggactactagtggattagtaaaagaagcggaggcagaacaacaccagggggcgacaaacaaagacgacagccagacgaaacccagcggggggccaacgacacgcgggaaaaggccgcaaaaatacgggcgagaacgattggtggaaaatattgtgttgaatgaagccgcatacacgacaacagaagagagacgacaggaacatagagggtgaaagagtacgcaatcgagcaaacaggacgacagcgcaaatcctcacgccn

SEQ ID NO: 327842 - DNA, 547 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327843 - DNA, 538 bp, Homo sapiens
tccgctgcggcacacttaacgtcattgctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327844 - DNA, 694 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcatgtgtctggttgtttgaaaaaaaaaaccacccacaaaacaaaaaaacttggggggggcccggacccacatggcctatacgagccgattacaatcactgccggcgtttaaacgtcggactgg

SEQ ID NO: 327845 - DNA, 739 bp, Homo sapiens
  misc_feature (703)..(703): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttccatggcctgtatgagagaaaagacctcagaaagcacgaaggacgcagaacagatgagaagtcaggggactgcaaggccaatgttggtctgcaaagtgagctggagattggatcacagccgaaggagtaaanataactcgccctcgtcggacgggtgagttggcttat

SEQ ID NO: 327846 - DNA, 923 bp, Homo sapiens
  misc_feature (917)..(917): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaaacaccttttgcggcccgccctcgcggcccctccgaaaaagctcttttctaacacccttccgttgggcgacggtgggccccgagttgaggttagagtgtgacaccatgtggctcaatagcgtgtgttcccttgagggaaactcgcgtggctccagtgaacataggtgcgtgggaatttctctccaccaattttaaaaaaaacgcgccgggggggacaacccgagaggctgttttgagaacaaattcccaaaatgggaggttactcggagggtccataaacgggggatctctttccaaacgggaggtgtcccaagggagacttccgatttcaatttacccccgnccttgg

SEQ ID NO: 327847 - DNA, 616 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcaaaaaaaaaaaaaaaaaaaaacaaaacaaaaaaaaaaagggggggggggcaaaaaaaacccccgggggg

SEQ ID NO: 327848 - DNA, 772 bp, Homo sapiens
  misc_feature (6)..(6): n is a, c, g, or t
  misc_feature (611)..(611): n is a, c, g, or t
  misc_feature (614)..(614): n is a, c, g, or t
  misc_feature (618)..(619): n is a, c, g, or t
  misc_feature (621)..(621): n is a, c, g, or t
  misc_feature (629)..(629): n is a, c, g, or t
  misc_feature (647)..(647): n is a, c, g, or t
  misc_feature (676)..(676): n is a, c, g, or t
  misc_feature (678)..(678): n is a, c, g, or t
  misc_feature (680)..(681): n is a, c, g, or t
  misc_feature (686)..(686): n is a, c, g, or t
  misc_feature (688)..(688): n is a, c, g, or t
  misc_feature (690)..(690): n is a, c, g, or t
  misc_feature (703)..(703): n is a, c, g, or t
  misc_feature (707)..(707): n is a, c, g, or t
  misc_feature (709)..(709): n is a, c, g, or t
  misc_feature (718)..(718): n is a, c, g, or t
  misc_feature (722)..(722): n is a, c, g, or t
  misc_feature (735)..(735): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttccaaaaaaaaaaaaaaaaaaaaaaacaaaactttgtgggcgcgctcgggccccgaaaaagttttnaanaccnntncgttgggnccgggcccatggtagganccggcccaacgggcccaaggaacccggcngnanngggcngntncccccaataaaangccngnggaccggcngtcngacaacccagggnccggggcctcggccatcccagggcccagggccgatta

SEQ ID NO: 327849 - DNA, 679 bp, Homo sapiens
actctttgaggaccccatcgctaagaaaccctctaatcattcgctttaccggataaaactgttttttgcgctcttttcctccttggctgtctgaagatagatcgccatcatggtgagtctccctgggcccgtgcagtcatctgccgcgtatccgagccatccgtggtccctgggtcccagtacttgagctatagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327850 - DNA, 655 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcaaaaaaaaaaaaaaaaaaaaaaaaaaaaaaaaaaaaaaaaaaaaaaaaaaaaaaaaaaaacaaaacaaaaaaaaaaagggggggggggcaaaaaaaacccccgggggg

SEQ ID NO: 327851 - DNA, 1048 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttctgtgtctggttgtttgaaaaaaaaaaaaaaaaaaaaaaaattgggggcacaaatgccggggtggcgagaaaaagagcgtcacggaatggggccaaggggccactaggtggtacatggaccccagtttcttggtaccaaagggggaacatctggcgcgacacccatatagaagagtcggcactaaattccgataagccagggtaacccggaattactgcactcgcgcgccaaaaagaacacacagagccgcaagacgagacgcgcgaaagaacgcgacaaaaacgaacaaagaggggggaaaacaagaaagaaacaagaaaaagaagagaggcagagaaaaggaaaacaaacaaggacaaaaaccaaaacgacaacaaacgacggaacaacaacacaggaagacgaaaaaaagacaaaaacaacgaaaaagacaaaaagcaaaaacaaaaaagacaaagagaaaaacaaagagaaaaaaacaaagaaaagacaaacaagaaa

SEQ ID NO: 327852 - DNA, 583 bp, Homo sapiens
  misc_feature (6)..(6): n is a, c, g, or t
  misc_feature (554)..(554): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcataaaanaaaaaaacattggacaataaaaaccttgt

SEQ ID NO: 327853 - DNA, 737 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcagacccagggcgctggggctgcagcgcgcaaggtcgaccacggaagctgcgcaaggaaaagccccgggatgcggcccgaaaccggcgcacgccaggaaccgggtgctgtaccagtggatcaaagctgccgtcagccggggtagccgcaccgtgaagccctatagggcctacatagacggatgacgcttgg

SEQ ID NO: 327854 - DNA, 982 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcaaaaaaaccgggggatctatggggggggggggaaaaaggggtttgaaggggccggggacaagggtccggaaccacatttttccgggcccaaggggggaaaaatccgggcagggttcacccataaaaggggaggccatataaaaagggcaaagaagccgttaagcctcggataagacgcggcacaaaacgagcaatcgcgacaaaacgcacagcaggcgatactagaacaggggtacccaacagttgaaacacacaaggaggtgacgaacaacatcacgcactagcatccagcctgccacatcgccacaacaagaactaaacaaccgacacacatcgacaacacagtcacagccagcaacgagaagatcagccacctacaacgactcacgcaaagccataaaaacagaacacaaagcagaacacagcaacacgcac

SEQ ID NO: 327855 - DNA, 640 bp, Homo sapiens
  misc_feature (6)..(6): n is a, c, g, or t
  misc_feature (552)..(552): n is a, c, g, or t
  misc_feature (561)..(561): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcaaaanaaaaaaaanggaacgatatgcatgcggccgcatttcggctcatttgccaattcgccttatgtgaggcgtataccattcactggccggg

SEQ ID NO: 327856 - DNA, 712 bp, Homo sapiens
  misc_feature (6)..(6): n is a, c, g, or t
  misc_feature (562)..(562): n is a, c, g, or t
  misc_feature (567)..(567): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttctgtgtctggttgttnaaaanaacaaaacacaccaaaaaaaacaacaaaaaaaaaaaaaagggggggccgccaaaaaaaaacacaccaagggggccaaaagaaaaaccaaggaaaagggggaccaaaagagaaaaagggggggggggcggaaccgggggggggaaa

SEQ ID NO: 327857 - DNA, 1024 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttctgtgcaacgccaacacacaccgacacaaacaacaaaaaaaacgcgcaaacaaccacaagaagcaaaccagaaaaaagacgaaaaaacaaagagaaaagaaaaagaaaaaaacaaaaaacaaaaaacacaaaaacagaaggcggcagcgagacaaaaaacaaacagcagcagagagagagagaaaaagacgcgagcaggcagagacgaacagagagaaacttgagaaacgaaaaaagaaagaggagagacaacaacagcagacaagaccaacacgcagcagacgaagagaaacaaaatgtggggagaaaaaaaaccaacacacaagcacgcggagcaaaacagaaaggtgagaaggcacagacgaagcgagagaaacaggaagaaaaaacagaagagaaaagaaagaaaaggcaggcagaagggaggcgaaagcccggaaaacagaaacacaaaaaggaacagaaaaacagcgcacac

SEQ ID NO: 327858 - DNA, 1167 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcccccgagtttttttttttttttttaatttaaatccccccaaaaggggtttttttccccgggagagttttgtagtccaccagaggggggtatttcgggaagaggattctggaggtatgcgcgccgggcgggccacgggggccctccacaactttttgggggccttcgcaggcagccaagggtgtccatcatataccagccaggggggcccgggctaacagacgggggtagcagaggagcgtcgtttgagactcctcccttccgttgggagaagcccctcgtacccaaatattttctcttgggtaatattatgccccccccgggggtttgggcaaaagaggcccaggcggagaagataacaaaatgctgggggccgaggtgacaccaacaccgctttttaacggagaacccggggggtggcttctacacccaaaagaatatcgttctcgtgccaaaagcataaaatggcctcccaccgagtctgtactggtaagaggggggcgcggatccaaaaacattctcccgagaggagccgacgcttcacccctgtatgacgaaccattggccgcggcttgtgctaggcggcccaaaggtggcgagagtattcttggggtccgaaagc

SEQ ID NO: 327859 - DNA, 1189 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcaaaaaaaaattttgggggggcggggcaagaaagaaattttttaaacccctccgggtggggcgcgcgcgggcgacccagggtggtgtaacagtgcagaactgcgtggcccaaaggggcgcggtcccaaaggagaacccgtgggcgcagacacaacagcgcggctgcgaggagctgggttcttcccccccccaatatataaaaaaaaacagcgggccgccgggggggaggagagacaaccaaccacagagtaggagagcagacgagcagatcgaagcatatattaatagctacagcactagcgacagtagacagagcacacagacacgagcaacaccaaacaacaaaaacaataaaaaaacaaacaatctataacaaccctagaaaaagagaatataaaaagaaaagacaaacaattagaaaaaaagaaacgatagtaaggaaaaaacaaataaggtagtagatagaggagtaataagataagataagaagataaagagaagagaagaggatggaagttatagaatatatttataagagtagaaagtaaaaaaaattaggtattaaagaagtatagaagaaagagagaagaataaaaggaaaaaagaagagagagagaagtataagaaacagataataaaataa

SEQ ID NO: 327860 - DNA, 673 bp, Homo sapiens
  misc_feature (6)..(6): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcctcgagggggggccccgtaacccatttccccctataaggaggtcgttttacaatttcactggcccgtcggttttacaacgtcctggaactgggaaaaaaccctggccgtacccccaactttaattc

SEQ ID NO: 327861 - DNA, 630 bp, Homo sapiens
  misc_feature (6)..(6): n is a, c, g, or t
  misc_feature (546)..(546): n is a, c, g, or t
tggtgntctcgaggatcccctcctcagcagacgcagctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacctcgtgccgaattcggcanagacccgtcaccaccttggtggaggaacaagaaaagcttcagcttggtggtgattgcacacggacgtggttccccattcgagct

SEQ ID NO: 327862 - DNA, 960 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcaagccgaaggagtaaaggtgctgcaatgatgttagctgtggccactgtggatttttcgcaagaacattaataaactaaaaacttc

SEQ ID NO: 327863 - DNA, 938 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaa

SEQ ID NO: 327864 - DNA, 1161 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaaggcctccttggagcggggaaggagagctcttcagttcctttggcaccttcacgcagcatgcaagacgggctgctttttcttctgtttatggatgaggcacagagggtagatgacttgccccaagtccttcagctcattcatgctggggaaaggagtaagcttcaggcgtcttcccctggagttcacgccacctctgacagcaagtgagccgtttgctactcaagtgctgtttcttgcttttttaagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccc

SEQ ID NO: 327865 - DNA, 933 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaagggaagctgccaaagaatgtcgacgtcgaaagaaagaatatgtaaaatgtctggagagccgagttgcagtgctggaagtccagaacaagaagcttatagaggaacttgaaaccttgacagacatttggttctcccaaaacagattactagaaatatttaactatgaaactgaaggcagcatggtatagttgcttatgacggaatacaatgatatagctggcaagaatggtggcttcttttcttcgtatcattcatctctctctttaatcacttaacattcctaaaaatgttccactggtacgtattaagtcgtaggctattacttcaactttttaaagcagacaacaggctacaacatgtgcggtctcttaaactgcactatttgtaggttgtccaaggccacatactggggtcccattctagtggccacccagggcctcggaacaatttgac

SEQ ID NO: 327866 - DNA, 921 bp, Homo sapiens
  misc_feature (915)..(915): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagattggatcaagccgaaggagtaaaggtgctgcaatgatgttagctgtggccactgtggatttttcgcaagaacattaataaactaaaaacttcaaaacaccttttgcggcccgccctcgcggcccctccgaaaaagctcttttctaacacccttccgttgggcgacggtgggccccgagttgaggttagagtgtgacaccatgtggctcaatagcgtgtgttcccttgagggaaactcgcgtggctccagtgaacataggtgcgtgggaatttctctccaccaattttaaaaaaaacgcgccgggggggacaacccgagaggctgttttgagaacaaattcccaaaatgggaggttactcggagggtccataaacgggggatctctttccaaacgggaggtgtcccaagggagacttccgatttcaatttacccccgnccttgg

SEQ ID NO: 327867 - DNA, 587 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaacttgcgaaaaatccacagtggccacagctaacatcattgcagcacctttactccttcggctgtgatccaatctccagctcactttttgccagcaccaacattggtcgacgcggccgcgaat

SEQ ID NO: 327868 - DNA, 534 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagattggatcacagccgaaggagtaagtgctgtcctataaacttgcgggccagctcagt

SEQ ID NO: 327869 - DNA, 659 bp, Homo sapiens
  misc_feature (488)..(488): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacanccgaagttgtggagctggcagggaagtgtgttgttggagtcgagcctggctgcggtggtaggttgtagattcttcaacaggggctgttgcggtgctaggaggtgaaggcgtcgtgtgagttgagctgggtgggtctggaagcggtagattctccctgagcgatcctctaga

SEQ ID NO: 327870 - DNA, 583 bp, Homo sapiens
  misc_feature (522)..(522): n is a, c, g, or t
  misc_feature (533)..(533): n is a, c, g, or t
  misc_feature (558)..(558): n is a, c, g, or t
  misc_feature (568)..(568): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaaagtggagcttgggagggatttggttcaacaaggccggaaggtggtaaaagggttncttccaattgnttgttaggttgttggcccacttgtngggttttttnggaaggaccattaat

SEQ ID NO: 327871 - DNA, 518 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagcctggaaaattttgggggaaattcccaaaacccccaaaggggcccc

SEQ ID NO: 327872 - DNA, 592 bp, Homo sapiens
  misc_feature (480)..(480): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattngatcacagccgaaggagtaaaggtgctgcaatgatgttagctgtggccagtgcatattagtggacagcacttagtagctgtggaggaagatgcagagccagtgtggagagag

SEQ ID NO: 327873 - DNA, 582 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaagtgagctggagattggatcacagccgaaggagtaaaggtgctgcaatgatgttagctgtgggggctgctgaggtggaacctgatgctgcagcgcctgtgacgtctgactcaagtgt

SEQ ID NO: 327874 - DNA, 572 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaaagtgagctggagattggatcaagccgaaggagtaaaggtgctgcaatgatgttagctgtggccactgtggatttttcgcaagaacattaataaactaaaaacttc

SEQ ID NO: 327875 - DNA, 525 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaatgagctggagattggatcacagccgaaggagtaaaggtgctgcaatgatgttagctgtg

SEQ ID NO: 327876 - DNA, 572 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccagtgcatattagtggacagcacttagtagctgtggaggaagatgcagagccagtgtggagagag

SEQ ID NO: 327877 - DNA, 806 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaa

SEQ ID NO: 327878 - DNA, 510 bp, Homo sapiens
  misc_feature (474)..(474): n is a, c, g, or t
tacaccctgttccagcctaaaaatcctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagagaaaagacctcagaaagcacgaaggacgcagaacagatgagaagtcaggggactgcaaggccaatgttggtctgcaaagtgagctggagattggatcacagccgaaggagtaaanataactcgccctcgtcggacgggtgagttggcttat

SEQ ID NO: 327879 - DNA, 1152 bp, Homo sapiens
tacaccctgttccagcctaaaaatcctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaac

SEQ ID NO: 327880 - DNA, 449 bp, Homo sapiens
tacaccctgttccagcctaaaaatcctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgatgggagaagactggatcttcgtcccatcagcggatttctatacattgacctcttgtttgttatcaaaacagcagtcctgattggagcagactgcgg

SEQ ID NO: 327881 - DNA, 537 bp, Homo sapiens
  misc_feature (48)..(50): n is a, c, g, or t
  misc_feature (66)..(66): n is a, c, g, or t
  misc_feature (89)..(89): n is a, c, g, or t
  misc_feature (105)..(105): n is a, c, g, or t
  misc_feature (110)..(110): n is a, c, g, or t
  misc_feature (125)..(125): n is a, c, g, or t
gaggagtcccttccggggcccgagcgcgttgaggtatcctctgagggnnngttgcgggtgacgcanaccgcaattttttccgcgctagnaaagttcatgcaccanaccgnactactctcagaagnaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttc

SEQ ID NO: 327882 - DNA, 420 bp, Homo sapiens
  misc_feature (36)..(36): n is a, c, g, or t
  misc_feature (48)..(48): n is a, c, g, or t
gttgctgcggtcgttctagaggatcccttcatgtcnagggccttcatnccgggaaggcgacagtgcctaagacagaaattcgggaaaaactagccaaaatgtacaagaccacaccggatgtcatctttgtatttggattcagaactcattttggtggtggcaagacaactggctttggcatgaaaggcctcgaatgaattcatgtcagccccttcatccccaagacaactgcaatacactgagaaggtccagagcagtggaagctgaagagacaactctttgtgtgtgtatgtctgttcaccggatctcgaagacacctgagtaccatgtcagtcttcatgacctgatcacctatgactcaatacagatggtgaagtcaagacgttcctactgagaagggcatgaagcactggatatgaa

SEQ ID NO: 327883 - DNA, 895 bp, Homo sapiens
cggccgctactactactaaattcgcggcccgtcgactgtctgagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccc

SEQ ID NO: 327884 - DNA, 710 bp, Homo sapiens
  misc_feature (674)..(674): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaagcacgaaggacgcagaacagatgagaagtcaggggactgcaaggccaatgttggtctgcaaagtgagctggagattggatcacagccgaaggagtaaanataactcgccctcgtcggacgggtgagttggcttat

SEQ ID NO: 327885 - DNA, 625 bp, Homo sapiens
  misc_feature (596)..(596): n is a, c, g, or t
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcctttagtgagggttttcgagcttngcgttcatgggcatagctgtttctgtgtg

SEQ ID NO: 327886 - DNA, 760 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcatgttgaacacaacaaacacaaaaaaaactccgggggctctctatgccggggggcggccacacgccggtctcggactggcgcccgtggccataagctggttcccttgaccaagtttctttgtccacgtgggtaatcggcgggtccctatagggagccgctattcgaagccggtacgtgatccgcccca

SEQ ID NO: 327887 - DNA, 970 bp, Homo sapiens
aagcagtggatcaacgcagagtgcccattatggccggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaaaaaaaaaaacaaacaaaaaaaaaaaaaacaaaaaaaaaaaaaaaaaaaaaaaaaaaaaaaaaaaaaaaaaaaaagggggggggggggaaaaaacgggggggaagaatatagcagcaacacatttttgtaaaggggccccccagagagataataaaaacagggcagagcggcaaaaagcagggaagaaacaactagtcgtgatttgaagaaccaccattgcgggggtgaatggagaccaccgagaaaggcgccgacaaaacatgagagtgtaccgcttgttcgcgagttctccttttttatctgcgatcataccaaggacgcggcagaatgagcacgagacacggtagtgagacagctcaaaataaaccaaaaagagacgcaagaacaaagaccac

SEQ ID NO: 327888 - DNA, 701 bp, Homo sapiens
actctttgaggaccccatcgctaagaaaccctctaatcattcgctttaccggataaaactgttttttgcgctcttttcctccttggctgtctgaagatagatcgccatcatggtgagtctccctgggcccgtgcagtcatctgccgcgtatccgagccatccgtggtccctgggtcccagtacttgagctatagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327889 - DNA, 603 bp, Homo sapiens
actctttgaggaccccatcgctaagaaaccctctaatcattcgctttaccggataaaactgttttttgcgctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327890 - DNA, 546 bp, Homo sapiens
  misc_feature (18)..(18): n is a, c, g, or t
cacccaatcggctaggtncgaggctgggtggtgctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttc

SEQ ID NO: 327891 - DNA, 334 bp, Homo sapiens
cgtgatctcgactcactgcaacctctgcctcctacgttcaaacaattctcccacctcagcctactgagtagctggaattacaggcatgcaccaccacacctggctaatttttgtatttttagtacacacggggtttcatcacgttggccagcctcatttttttttgtatttttatgtagagatggggttttgccatgtcacccaggctgttcttgaactcctacgctcaagtgatccacgtgcctcagcctcaaatgtctattaatgatcaatacagaccaatttcagggcttttttgggtataaaaagtaaggatagtagaggccgggcacgg

SEQ ID NO: 327892 - DNA, 2663 bp, Homo sapiens
gtggagctgccgcacgtgggagggcgctggccaggcagcactgtggcctctgcggctaggccggctcgagactcccgggcgccgaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacaggtgagttttttttttcccccagtaaacctgccaattagtttttttagaaaacttcttgactgctgtcaggtttctgctcctaacaggttttttcagaagctgaatgtgttcaagaattttataggccttctgcaaaaccaaaattttccttatcctgtcctctttcacaacatatttttacttggaggttcatctaccagtgaaagatgtttgttgaataacagcctatggaaaaagaataagactatctgtaaggaaaggttacaaatactttgctttttccttttaatcctttaggaatttgatataaatttctcagaaaaactgtgctgtaatctgtctcttctgcttatcaatgctttgtttactttagtggtttttcaatcctcttagaccctttactcatttttaaataataattttgtaacatttgcctttactaacttcaaattaaaatcatagataatatagtctaaccatgcaaagaatttgccagagtggaggtgtatgtgtgcagtagattaaaactgatttttttatttctgaaaataaaaagtacatttattctcaactttgtaatacagtccatttaattaggcccagactattctagcatgaaccatatgaacttgctaacatttaaccattattaacatatgaaaatgtctagttcagcaattcaccgtaatagttgaaatatactgttatttggctgggcatggtggctcatgcctgtaatcccagcactttgggaggccaaggtggaaggatcgcttgagtctaggagtttgagaacagcctgggcaacgtggtaaaacaaacaaaaattatccaggcatggtggtatgtgcctgtggtcccagctactcgggaggctgaggtgggaggatcacttgagttcaggaggttgaggttgtagtgagccatgattgtgccactgcaccacagcctgggtgacagagcagaccttgacttaaa

SEQ ID NO: 327893 - DNA, 3123 bp, Homo sapiens
gctagaccgtccctgtggagcgccatgccagtagataggatgatgatggtcgtacactgtgcctacagaaatctctggacatagagatattgtgctttggattctcaccattagaaaacgcctggtgcaaaccgttctttgtgtgactgatcctgatgcacgtgcgtgagagtcatcactggaatctctgaactggcaggtccgagtcgagctcgattatctgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaactttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaat

SEQ ID NO: 327894 - DNA, 3706 bp, Homo sapiens
gtggagctgccgcacgtgggagggcgctggccaggcagcactgtggcctctgcggctaggccggctcgagactcccgggcgccgaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataacctacaatagccacacataccctccgttaccctctagaacag

SEQ ID NO: 327895 - DNA, 3209 bp, Homo sapiens
  misc_feature (1245)..(1245): n is a, c, g, or t
  misc_feature (1753)..(1753): n is a, c, g, or t
  misc_feature (1784)..(1784): n is a, c, g, or t
  misc_feature (2666)..(2666): n is a, c, g, or t
  misc_feature (2953)..(2953): n is a, c, g, or t
  misc_feature (3077)..(3077): n is a, c, g, or t
  misc_feature (3130)..(3130): n is a, c, g, or t
  misc_feature (3161)..(3161): n is a, c, g, or t
gtggagctgccgcacgtgggagggcgctggccaggcagcactgtggcctctgcggctaggccggctcgagactcccgggcgccgaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggtaagtggtgttataaatccctttaaagagggaaaaactctacaacaaaaaagaacattcagtcataaataaaacatactgactggattttcttagcttttgtttcgaatgattataaaaccataatgggcattatatagtattacataatgttaattatatcgttgaggttatgttgagctgctaattccattcacttaaagaccaaatgtagaagagtgaacatctgtaaagttaaggctttttaataacattatgaacttgatggttacatgtaagggttatcttagaccaaatcaattagaagcaaatggaatcaagttgtttatctgtaaatatctcgtggttttggaaccataatattgatgacatactgttgatgctgtatgccggagtcattcctgtctgtcatccttacatttttcaagacttggggaaattatggataataaatgttctaggtgggtctgtccaggtgtttttgatctttttaccaatgttgatttgcctcctagcagctttcaatttttattttcatgacacttcagcaatttttttggggaaaaaaaacagtttcaaaattccaggctttttttttgtttaattttgcatgtttctttctgcagaatcctaattntttttcctttttagcagaccgtgacaagagttggaatatttaatattttaaattaaatagcattttaatttgtaactcattatacaatgtgtcatcaagatttagacatgtaaaatgtatatcctattttctcatatcagacaagcatttttcatcctataattgataatcatataattcataataattcacatttggtctataaacttcatggtgaaagtaagttatgaaaataactttatgattattcttcattagctaaattgttcttcttgctccttttgaccacagttatttgatgtgatttgaatcatggtctttatagtctcctcattttatttcatccccaaattacatttctttgttgttctattttttttatgtaatttggaatttttcctagaatttccagtttcctttgattaatcctattttcatcatgatttctaagttcttatttggaataatgtttttgtttttatttcacattctgtgattcttatgaatnttatcaagatatgaaaggtttgtcactttanatttctttgtcatagagtacttttaaattttgtgtatttgagaccagcctggccaacatggtgaaactccatttctactaaaaatacaaaaattggccaggcacggtggctcatgcctgtaatcctagctactcaggaggctgaggcaggagaatcacttgaacccaggaggcagaggttgcagtgagctgagatcatgccactgcactccagcctgggcaacagagtgaggctccttctcaaaaattaaaataaaataaattttctatagttttgggattgatcccactaaacttgggaacaaattgctgactctagagtagactggcacactatagtgacctgatagacaccaatgcgttcatcagatttgtgtctttatttgagctggttcatttcgggcctttattttaacaatttaaggtaatttcagatttggttctgtaattctggtttctataatttttattgtgtgaacattttttaggggcttctacaacatttgctaactctacatcaggataataaaaaataactattgtgtttgtttttgcattgaaggtcattaggtgaatttacctacctttaaacatcttccatgacaaatggttatgtttatttaggcaatttttttaaaaacctagaattaccagtattagttctctgctggagttggacactttaataaatggtaaaacttatcccattcgtacctaaagggcaaaatcagatatccaaatattttatttattttctctgtgatactgtaagttaaataggatagccatgatatagcatataaagccttcattaatggctgggcatggtggctcacgcctgtaatcccagcactttgtgaggctgaggcaggcagatcacttnagctcgggagttcaagaccagcttgggcaatatggcaaaaacccatctctacaaaaataaaaaatagtggccaggtgcggtggctcacgcctgtaatcccagcactttgggaggccaaggcgggtggatcacgggaggtcagaagttcaagaccagcctggtcaacatggtgaaaccctgtctctactaaatatacaaaaattagccaggtgtggtggcaggcgcctgtaatcccagctactcaggaggctgaggcatgagaattgcttgaacccgggaggtggagnttgcagtgagtctagactgtgccattgggctccagcctgggcaacaagagcaaaacttcatctcaaaaaaataaaaaataaattaattaattaaaaatagaaaaattagctgagcatggtggtnagtgcctgtagtcccagctactcgggaggctgaggtgggaggattgcttgtgnccaggaggttgagactgcactgagcagtggntgtgccactgtactccagcctgagtcacagagtgagaccatgtctcag

SEQ ID NO: 327896 - DNA, 6270 bp, Homo sapiens
gtggagctgccgcacgtgggagggcgctggccaggcagcactgtggcctctgcggctaggccggctcgagactcccgggcgccgaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaactttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaat

SEQ ID NO: 327897 - DNA, 6216 bp, Homo sapiens
gtggagctgccgcacgtgggagggcgctggccaggcagcactgtggcctctgcggctaggccggctcgagactcccgggcgccgaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaactttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaat

SEQ ID NO: 327898 - DNA, 980 bp, Homo sapiens
ggtcccaatgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgcccaccgccccggcctgtcggaacttgagcgcacctccgacctcgggcgccagaggcctgcgccccctctccttccgcccagcacctccatgccctcggtgcacgaacgcggcggcggcggccagaagtcccccgtggcttatgaatgacacggacagagagcccagcgacgtggatggggcagctaggggcagcagcttggatgcggaccctcagtcctcaggcagtccttcagctcctacttaatggaagcctcgcagatgcaagatggctccagcaggcccagcatcacttcttctcagtgtcccaaagccagaagagaggctgttgtttttaaaagcaggaaaactttcctaaacttggccagaattgcatcacagaccctttcctaaaacaatttccagcaaagggaatagacttaccatgtctggtacagatgaatcaaggtttgcccctgggggctggggaggggcttgtcccgctgaagcagactcttgcccagcagctgaacggagcctaggttcaccagacggaggaagagactggccactaacagtgcctgacacacagatgtgcttcctgtgatatcgctgctgccaccgttccaaatgtaagcagttggctgtctgggatactacctaccttcttttgtgttcttattaataaaattaaagattgctttctgggtagaga

SEQ ID NO: 327899 - DNA, 1829 bp, Homo sapiens
ggtcccaatgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgcccaccgccccggcctgtcggaacttgagcgcacctccgacctcgggcgccagaggcctgcgccccctctccttccgcccagcacctccatgccctcggtgcacgaacgcggcggcggcggccagaagtcccccgtggcttatgaatgacacggacagagagcccagcgacgtggatggggcagctaggggcagcagcttggatgcggaccctcagtcctcaggcagggagaaagaacctctgaagtaagccctcacctctgcaggtggggctcaggcccagagactgggatcagctggctcaggcagctcaggtcctggttcgtcccctagcccaggaggatgctgtgggagctgcagcagcggcaagagggagaatggggggaagcagcactagagaagttcccagagctcatcctgtcactggctgctctgctgaaattatcaataagaaatgccagttggatctgtgacatgtctgcctgcagctggatgggagcaacggacagcttgtcctccgaatgtgttttctgtatgtgtgcaagcgcgtgtgttccaaacgggcagtagcgtgtgggaaggaaaaagcctgacacttgtttttatcaatttgctgatgctcagtcccggcggctgcctcctttgcccccagctgctctgccatttctctcttttcaatcctgcatgatcctgagcagagataaaagcagatttccgcttctgctcccagatccaggagcagaccctgcaggcagctgctcctgatgtctcacagctattagtcttcaaaaaccccccgtgcctctgtgcacacgcgtctctcctccccagccagcccccctcccagcccagcggcgatgtctctgcctggctggcccgtgcccttgacttccaggcagtagaagatggagttctctagacagcagcacttcagccgccactctgcctctgaagggaaggaagggaaaggggtgctggctactgtgaaataacaagagtccaagagcaaggtgtccagagtcagagctcctgggtttgaaccttgttccaccagcacatcctacctctgtggcctggtccttcagctcctacttaatggaagcctcgcagatgcaagatggctccagcaggcccagcatcacttcttctcagtgtcccaaagccagaagagaggctgttgtttttaaaagcaggaaaactttcctaaacttggccagaattgcatcacagaccctttcctaaaacaatttccagcaaagggaatagacttaccatgtctggtacagatgaatcaaggtttgcccctgggggctggggaggggcttgtcccgctgaagcagactcttgcccagcagctgaacggagcctaggttcaccagacggaggaagagactggccactaacagtgcctgacacacagatgtgcttcctgtgatatcgctgctgccaccgttccaaatgtaagcagttggctgtctgggatactacctaccttcttttgtgttcttattaataaaattaaagattgctttctgggtagaga

SEQ ID NO: 327900 - DNA, 1910 bp, Homo sapiens
ggtcccaatgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgcccaccgccccggcctgtcggaacttgagcgcacctccgacctcagtgtgcggcacagatgtgccattgctgcccacctctcacttcctgcaccaatgcgacctaccatggccctctgtgttgcactgaaactgctgtgtctggctgtgctggcgcaagaatgtccaccctgatggctttattgaattgaccactgggacatgacgacgccccagctgactgttgcgattgtggtgccagcctatgtggtgcagcatgctttgtgactgcctggactcctcacgtcctcagtgcatgggacgaaactgggagaaagaacctctgaagtaagccctcacctctgcaggtggggctcaggcccagagactgggatcagctggctcaggcagctcaggtcctggttcgtcccctagcccaggaggatgctgtgggagctgcagcagcggcaagagggagaatggggggaagcagcactagagaagttcccagagctcatcctgtcactggctgctctgctgaaattatcaataagaaatgccagttggatctgtgacatgtctgcctgcagctggatgggagcaacggacagcttgtcctccgaatgtgttttctgtatgtgtgcaagcgcgtgtgttccaaacgggcagtagcgtgtgggaaggaaaaagcctgacacttgtttttatcaatttgctgatgctcagtcccggcggctgcctcctttgcccccagctgctctgccatttctctcttttcaatcctgcatgatcctgagcagagataaaagcagatttccgcttctgctcccagatccaggagcagaccctgcaggcagctgctcctgatgtctcacagctattagtcttcaaaaaccccccgtgcctctgtgcacacgcgtctctcctccccagccagcccccctcccagcccagcggcgatgtctctgcctggctggcccgtgcccttgacttccaggcagtagaagatggagttctctagacagcagcacttcagccgccactctgcctctgaagggaaggaagggaaaggggtgctggctactgtgaaataacaagagtccaagagcaaggtgtccagagtcagagctcctgggtttgaaccttgttccaccagcacatcctacctctgtggcctggtccttcagctcctacttaatggaagcctcgcagatgcaagatggctccagcaggcccagcatcacttcttctcagtgtcccaaagccagaagagaggctgttgtttttaaaagcaggaaaactttcctaaacttggccagaattgcatcacagaccctttcctaaaacaatttccagcaaagggaatagacttaccatgtctggtacagatgaatcaaggtttgcccctgggggctggggaggggcttgtcccgctgaagcagactcttgcccagcagctgaacggagcctaggttcaccagacggaggaagagactggccactaacagtgcctgacacacagatgtgcttcctgtgatatcgctgctgccaccgttccaaatgtaagcagttggctgtctgggatactacctaccttcttttgtgttcttattaataaaattaaagattgctttctgggtagaga

SEQ ID NO: 327901 - DNA, 1714 bp, Homo sapiens
ttcctccctactcttgcctcccacagagagcccagcgacgtggatggggcagctaggggcagcagcttggatgcggaccctcagtcctcaggcagggagaaagaacctctgaagtaagccctcacctctgcaggtggggctcaggcccagagactgggatcagctggctcaggcagctcaggtcctggttcgtcccctagcccaggaggatgctgtgggagctgcagcagcggcaagagggagaatggggggaagcagcactagagaagttcccagagctcatcctgtcactggctgctctgctgaaattatcaataagaaatgccagttggatctgtgacatgtctgcctgcagctggatgggagcaacggacagcttgtcctccgaatgtgttttctgtatgtgtgcaagcgcgtgtgttccaaacgggcagtagcgtgtgggaaggaaaaagcctgacacttgtttttatcaatttgctgatgctcagtcccggcggctgcctcctttgcccccagctgctctgccatttctctcttttcaatcctgcatgatcctgagcagagataaaagcagatttccgcttctgctcccagatccaggagcagaccctgcaggcagctgctcctgatgtctcacagctattagtcttcaaaaaccccccgtgcctctgtgcacacgcgtctctcctccccagccagcccccctcccagcccagcggcgatgtctctgcctggctggcccgtgcccttgacttccaggcagtagaagatggagttctctagacagcagcacttcagccgccactctgcctctgaagggaaggaagggaaagggtgagggatgccgcagagcagagggaaccgctggggaggcgctcagggtgggggaggaggtgcaccccgctggggagggcctgctggtacctcggggagcctggctggggtgtgtgcgaaggcagttctgtgggagcctctcaaagtagggcaggcaggaggcagggggaaagtcacactagggaaggagcctgcagaggcaaagccagagcgccagcctgacccaggccgtgagcccgtgatcgcctgtctcagctcctgtcagcctgtctctctctttggaggcatcggccttcctggtgacaggcctgtcaggctgagggccagagggcactgttcccgggacccagtctgtgttccccgatcctatctgcatttattctctatttgccatgttcctgtcacctcatccttgctgccatttccgagttgctcatctccttccactggtctgaggaattgtcaggccaaggtcatggagctggctcacggcccagacgcacttccccagggcagcgcccctccacgccactgttccgagaacctgcgcaggaggtggtggctgctccagggatccatccagaggaagggcgggaaaaagagaggaaggggctgctggcggccagcggggctgtggctgcctgggcttggaggttgcctgggcagctggggtgccatgtgggccgggtgggggggctgtctcccccagggagcaggctggctttggtgggagcagattgtgtttacaccttccccgcacacccagcccacgctcgcctcttattcccggggcctctcccacccctgggctctctgcgcagtctgcacatttgcagctcctgctgcagaaagttacctctctcagcctagagctccc

SEQ ID NO: 327902 - DNA, 2133 bp, Homo sapiens
ggtcccaatgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgcccaccgccccggcctgtcggaacttgagcgcacctccgacctcgggcgccagaggcctgcgccccctctccttccgcccagcacctccatgccctcggtgcacgaacgcggcggcggcggccagaagtcccccgtggcttatgaatgacacggacagagagcccagcgacgtggatggggcagctaggggcagcagcttggatgcggaccctcagtcctcaggcagggagaaagaacctctgaagtaagccctcacctctgcaggtggggctcaggcccagagactgggatcagctggctcaggcagctcaggtcctggttcgtcccctagcccaggaggatgctgtgggagctgcagcagcggcaagagggagaatggggggaagcagcactagagaagttcccagagctcatcctgtcactggctgctctgctgaaattatcaataagaaatgccagttggatctgtgacatgtctgcctgcagctggatgggagcaacggacagcttgtcctccgaatgtgttttctgtatgtgtgcaagcgcgtgtgttccaaacgggcagtagcgtgtgggaaggaaaaagcctgacacttgtttttatcaatttgctgatgctcagtcccggcggctgcctcctttgcccccagctgctctgccatttctctcttttcaatcctgcatgatcctgagcagagataaaagcagatttccgcttctgctcccagatccaggagcagaccctgcaggcagctgctcctgatgtctcacagctattagtcttcaaaaaccccccgtgcctctgtgcacacgcgtctctcctccccagccagcccccctcccagcccagcggcgatgtctctgcctggctggcccgtgcccttgacttccaggcagtagaagatggagttctctagacagcagcacttcagccgccactctgcctctgaagggaaggaagggaaagggtgagggatgccgcagagcagagggaaccgctggggaggcgctcagggtgggggaggaggtgcaccccgctggggagggcctgctggtacctcggggagcctggctggggtgtgtgcgaaggcagttctgtgggagcctctcaaagtagggcaggcaggaggcagggggaaagtcacactagggaaggagcctgcagaggcaaagccagagcgccagcctgacccaggccgtgagcccgtgatcgcctgtctcagctcctgtcagcctgtctctctctttggaggcatcggccttcctggtgacaggcctgtcaggctgagggccagagggcactgttcccgggacccagtctgtgttccccgatcctatctgcatttattctctatttgccatgttcctgtcacctcatccttgctgccatttccgagttgctcatctccttccactggtctgaggaattgtcaggccaaggtcatggagctggctcacggcccagacgcacttccccagggcagcgcccctccacgccactgttccgagaacctgcgcaggaggtggtggctgctccagggatccatccagaggaagggcgggaaaaagagaggaaggggctgctggcggccagcggggctgtggctgcctgggcttggaggttgcctgggcagctggggtgccatgtgggccgggtgggggggctgtctcccccagggagcaggctggctttggtgggagcagattgtgtttacaccttccccgcacacccagcccacgctcgcctcttattcccggggcctctcccacccctgggctctctgcgcagtctgcacatttgcagctcctgctgcagaaagttacctctctcagcctagagctccc

SEQ ID NO: 327903 - DNA, 159 bp, Homo sapiens
ttggagtcaggaagatgtggatagtggttaagagtatggactctggatttaaacggcctgggttcaaatcccatctctgtaaccttgggcaaattacttattctcagtgtctcagtctcctcgtcagcaaaatggagatgctgctagcagccaactgtc

SEQ ID NO: 327904 - DNA, 665 bp, Homo sapiens
ttcaatatgagttctgtggcagtctcacatggaagtcaggagtaacagcctcaattcctaaatagctgtttaccactgcttttttgagcatatttaagtaatacagaatataaaggagcaaacaaaatatgaagtttataaaagatttcaaacacttttctaaaaataagaggcccacattttagaggtatttcattccttttctcaaacaatatggacatttataaatatgagaatatatagatatacagaccttaataaatgaagtgttcttgaaaattttatatggaaaaccagttagctttaatttcttcacaatttttatggatttatccagatcaaggacaactcctgtggcagctatccgaaaatcaggctaacaggagccccaaaatttgaaaataggaataatattagcaagagaaaaacttcaattctatgtgacacaataaattaccaaagtgaattttacttacaattagttaagaaaaacaagagagaccatctgaacttgcaacccattggtttgacaaaagcaatccaaaactttaaagttggtaagccaaactaacaagggtgacttgaggccaggcacagtggctcatacctgtaatcccagcactttgggaggccaaggcaggtggatcacctgaggtcagaagttt

SEQ ID NO: 327905 - DNA, 603 bp, Homo sapiens
gcaagcagaaaaggagttaactagtgtcacatttgaagacgagcactgaggatgaggaaccaactgaagaatatgaaaatgttggaaatgcagcatctaagtggccaaaagtggaggatcctatccctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactgggg

SEQ ID NO: 327906 - DNA, 1473 bp, Homo sapiens
gtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatcaaaaaaactgtgagt

SEQ ID NO: 327907 - DNA, 744 bp, Homo sapiens
cgcgggttcttccggccgtgcggtccgcgcttttgtcccgctggcggccgggttcccgcggcgccgccacagccagttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatccctgaatctaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatcaaaaaaactgtgagt

SEQ ID NO: 327908 - DNA, 2544 bp, Homo sapiens
gtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatcaaaaaaactgtgagt

SEQ ID NO: 327909 - DNA, 2408 bp, Homo sapiens
gtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagtttatgctgtacagcataaactattatagacactggtatattttttccccaagtaaacaagatgagaatgacaggattcagcttgtctggcaaagttaggcttttcctttagaaaggcagtacgttgggagagaagttacatgtaatcaaccc

SEQ ID NO: 327910 - DNA, 529 bp, Homo sapiens
cccatgcaatcagtcacctccataaggtttaaagtgatgacctctgctctgtcgttctgttgcttggctcccacactaccagtccccactgctgaccagtcttcctgctgttccttctcagaatcttacaagggcccctctttctctgctttcccttgagcagggatattctgcaagctcatctgcctttccaattccatgtcctctccctgactgacttcattcctacctgtggcttgaaccatcaccgacagatggatgactctcaaacctgtatctcctattaaagtttctcccctgagcctcagaactttatattcatctgcctactgaacagctccatctagatactccaacggcatctcaccctccacatgtccacagataaactcatcttttaccctcagacctgatcatttcttcagcctctcccatcttacctgtggtgggaagtgggaacttatccagacccaaaacctctccctcccgctccagcaagctaccagctagttgtcctcatgcctggtcc

SEQ ID NO: 327911 - DNA, 1225 bp, Homo sapiens
ttggatatcttctagattcttcaaactcaatatatctaatgttgaatgctttccatctttcccttaaacatgttcttcctcctctattctcagtcttaatgaatataacagtttactcagtcacccaagccagagtctgggaatgatttttgagtccttctcctgtactattggcctcatccaatttttcacaaagtcgccatccctgcaggcttccatcatctctctccaggttattgctgcaatagtcatcttcacaactgttgctgcttgtattcactcttgccccagttcattctagcaccatggcacacacctgaaataccagctagtggggaggctgaggctggaggattgcttgaacccaggagttcaagaccagcctggacaatatagcaagaccctcttaagaaaaaatgcaaatctcatgtttctccattacttaaaatctgtcattggcttcctgttgcttttattttattttatttagttagtaattttgagacacagtctcattctgtcacccaggctggagtgcagtggtgcaatctcagctcactgcaacctctgcctcctgggttcaagcaattctcgtgcctcagcctcccaagtagctgggataacaggcgtgtgccatcatgcctggctcattttttttctttttgtatttttagtagaggcagggtttcatcttgttgaccaggctggtctcgaaccgctgacctcaaatgatccacccaccttggcctcccaaagtgctgggattacaggcatgagccactgcacccagccaacttcctattgcttttaaaataaagtccaacattattgatgaagctcaaaagccacttcataatctgaagaactccatttctctagatatattggattcctttccctgaaaaggagaaagttcttcccttttggtcctatttacattctgtttcctcagcttggaatattcttttccctaactcttctggtttactctatttacctttctgtttttaacttaaatattcctccttcaaggaatatttaatgaataaatacaggattggctatggaaaatcaacttcctcataattttgttacttgtttatagttatgccctcagagatattgcaggtttggttccagattgccacaacaaagtgaatatctcaataaagcaagtaatgtgaattttatggtttcccagtgcatataaacattgcttatacta

SEQ ID NO: 327912 - DNA, 598 bp, Homo sapiens
agtgcgatattctggtttcctatgtcactggaggtcagctactacagttttctacataaaaatgactgatcacaaaatgtgtcatatattatcagaagaacagaaggcaagctagttattggatttcaaaagctataaatctctacaatttaaacaagatctacaggatctcaagaaccttaaaagttctacatattttccattttaacttgttgctatctttgatcgcctaaaagattgcatatttttttaaagttatttttcctcttcctgttaatgacacctgctacaataagactttaaggccttttataaatgtatttataaggcaaaagttctaccaagctatatgagtttcaaattcctactaaaaaaaagactagaagaaaaatcaattcaatatccatactggccacaccaactacactgagaataaactccagggtttactttgtgggaagtgccatttactattagacaatgaaactttctacaacagatccttaaactataggaaaatgtcctcagggctctggcttagaaggtttaattattagctttaaaatccacactagggcaaagaagtctccaaattctg

SEQ ID NO: 327913 - DNA, 2599 bp, Homo sapiens
  misc_feature (1378)..(1378): n is a, c, g, or t
  misc_feature (1940)..(1940): n is a, c, g, or t
aaaattggatggaaagaaattctgtgtgctcccaggattccagttccttaccggaggttggtgccgtctgagtctgaaaagctgccctcttgccgtgttcatgctttggtagaacaccttcagagccttggcaagctctcggtcagagccagcttgctgtgtgcacatttggctcatctccccggcggatggcagttgcacagtcatcccgctgatcttcagagtgttggaaggcttcggggctgaggtggaaaaaggtaacattgatttatgtatctctttctctgggcatctctatatttattttggtggcattctactgcatcagcatttatcaggcaccagtttggatccatccaagggaaaggggaaatctcacagggcagaagaaatgtccggcattttttgtttatgaaagaagatacgaattaactcatttaaaagtttgtttcttaaaagacaaatacacatcccaaatgtaggagtctagggataagctaaacagccaagactggagcagtctctcaccttgaccagaagcagttttcgcaagtgatgctttgagaagcacgttctcctctctcagggctctgttaatgttcctgagcggttccgtctcctgctctagcttgagcagcttcagataaagttctggtatctggtttgatgctgcctaccagaaaacatgtcagtttcgtcttttgttgtatcatctgcatatcctttgagactggcaatgtttgctaccatgggaaaatcaaatgggatgggagtgtgtgtatggtgagcagagtttaagcccctcagggtacacaggagtaaataaagaaaacgtttgttaagggggaaggaacgtcaagcagccgtcctcagagattttctagccacctgggatgcccactttagtgtcctatgtacacacctggcttatatccttcacagtggaaattttcttggtgtctaccaggatgtggccttcacctgtgaccatgaggcccagctgagagcagctcagctcggtgcagccttctgtaatggggagagacacagtcaaagaaagaaacatcccagtcgcccagctccagtgtcagcttcatgcagtaggccagcgactggagccagatgtgagctgagcccaagcggacgacctcgacaggatcccagaaagggtcgtcatctcgagccacagggccgtgatctccatctagaaagcgctggtaaagttcctgcattaggaatttcctattgatgaacttggcttttgaccatatccacacctggaaacacagaggggtccacacccagtgcacagcagatccaggacaacagcctgccgctgtcttcctcctcactgggtgaggacagggcctctgtcagnactggctctggagaggaaacaaacctgaagccacaggaggagggattccagagggattccagccgccctctccagctggaagaagtcgtaatcgaacctgctcaggtcctcactgccccactccgaagaaaccccacgtacaggtgaggtcagaggagtgaagtgacttgcccaagaccacacagtgagtcaggagcaggcctgtccctccagcagtggtgccatgttgtccccaagccatggtggcagaggagctggtgtgaacgccccatcctgccacgtctgtgatgtgggcacctcacatgactgtcccctcccagctcttgggggggacctaggacattctgtgagcctgcaggaaagtttaccaaatgctgcagctttgtcctggtggtgatgggcaccccgttaacggcaaccttgcatttgctatgtggagtgaccgtcactttaccgtcggcatttgtgaaggaagcgtgtttatctgaaattctaagaagatgagagtcaaagacacccagcaaacggcggtttccgtgagcaggtaggctgacctttctcntgtgcacaggagggaaggtctacagctgcggaggatggcaggtggcatctcggggcctcctgtgtgctgtggcccatgatgcatggggacagcagcgggcgcagaaggaccctgcccttggggagcacggagagctgggagacagcaggcaagggcttcattaacagaacgaacaccagctgagggcctagcactgcggggagccggccaaggccacactggagtcctcccgctcccaggccagcgggatggggtggtgggaagatggcagcaagcaagcttcagaagagacgctcaggaggcgactcttaacgagcctcacctactccggggttggagcccaggaagcaaaccagcactgcaccctagatttcagccagaggacgaaagccctgccctcagctttctcagaccagccctggagtaggtggcccggggagacctgggcagtgtccctgcttgtcctgcagactgtgtggctctgcagacctctagatggaggaggcacaattctctaatgctggacgaggacactgatcatggaaactcaccccaaaccttgaatcgtgatagcatttgaggcagcctgaccggtgccacatgaacctgaaaggaatcaagatataatttattttgaaaataaatcagacactttcaga

SEQ ID NO: 327914 - DNA, 956 bp, Homo sapiens
atggggtttcccagggctcctgcggggcctcctgagggagcccttggggtcactccacagtctgggctttctgtagtccggtgggtcagggctccaagcaccaggagagatccagggatgcgcttatgtttgggccacccccggtgggcttgttcgttcagcccccttcgtttcctggcctgctctacttatatctgtttgtgaagaattattacacagaatctagaaaccagctttcccttttctcccagggttggagcccaggaagcaaaccagcactgcaccctagatttcagccagaggacgaaagccctgccctcagctttctcagaccagccctggagtaggtggcccggggagacctgggcagtgtccctgcttgtcctgcagactgtgtggctctgcagacctctagatggaggaggcacaattctctaatgctggacgaggacactgatcatggaaactcaccccaaaccttgaatcgtgatagcatttgaggcagcctgaccggtgccacatgaacctgaaaggaatcaagatataatttattttgaaaataaatcagacactttcagaatttgagcgtaagaagttaacatgtctgatgcgttggaagtgacgttttctctacagtgggatggtactgaagggatttttccagttgggattttcaatcataatggtacttagacatacttttctttctgccttgtgtgtggggggaagagcggggatgttcctaacttttaaaaagttccaccttcttcatgagcattctggaggaagacaccattaggtctgggccttaggagacccactgaatactggccacagcagaggttctggtgtttgaagctccgtttctgtgtagtgactgaccccaaggagtgcagacatgtcaccccccacatccccacatcccacggccatctcgcacggagccctcccggccg

SEQ ID NO: 327915 - DNA, 579 bp, Homo sapiens
atggggtttcccagggctcctgcggggcctcctgagggagcccttggggtcactccacagtctgggctttctgtagtccggtgggtcagggctccaagcaccaggagagatccagggatgcgcttatgtttgggccacccccggtgggcttgttcgttcagcccccttcgtttcctggcctgctctacttatatctgtttgtgaagaattattacacagaatctagaaaccagctttcccttttctcccagggttggagcccaggaagcaaaccagcactgcaccctagatttcagccagaggacgaaagccctgccctcagctttctcagaccagccctggagtaggtggcccggggagacctgggcagtgtccctgcttgtcctgcagactgtgtggctctgcagacctctagatggaggaggcacaattctctaatgctggacgaggacactgatcatggaaactcaccccaaaccttgaatcgtgatagcatttgaggcagcctgaccggtgccacatgaacctgaaaggaatcaagatataatttattttgaaaataaatcagacactttcaga

SEQ ID NO: 327916 - DNA, 2210 bp, Homo sapiens
aaaattggatggaaagaaattctgtgtgctcccaggattccagttccttaccggaggttggtgccgtctgagtctgaaaagctgccctcttgccgtgttcatgctttggtagaacaccttcagagccttggcaagctctcggtcagagccagcttgctgtgtgcacatttggctcatctccccggcggatggcagttgcacagtcatcccgctgatcttcagagtgttggaaggcttcggggctgaggtggaaaaaggtaacattgatttatgtatctctttctctgggcatctctatatttattttggtggcattctactgcatcagcatttatcaggcaccagtttggatccatccaagggaaaggggaaatctcacagggcagaagaaatgtccggcattttttgtttatgaaagaagatacgaattaactcatttaaaagtttgtttcttaaaagacaaatacacatcccaaatgtaggagtctagggataagctaaacagccaagactggagcagtctctcaccttgaccagaagcagttttcgcaagtgatgctttgagaagcacgttctcctctctcagggctctgttaatgttcctgagcggttccgtctcctgctctagcttgagcagcttcagataaagttctggtatctggtttgatgctgcctaccagaaaacatgtcagtttcgtcttttgttgtatcatctgcatatcctttgagactggcaatgtttgctaccatgggaaaatcaaatgggatgggagtgtgtgtatggtgagcagagtttaagcccctcagggtacacaggagtaaataaagaaaacgtttgttaagggggaaggaacgtcaagcagccgtcctcagagattttctagccacctgggatgcccactttagtgtcctatgtacacacctggcttatatccttcacagtggaaattttcttggtgtctaccaggatgtggccttcacctgtgaccatgaggcccagctgagagcagctcagctcggtgcagccttctgtaatggggagagacacagtcaaagaaagaaacatcccagtcgcccagctccagtgtcagcttcatgcagtaggccagcgactggagccagatgtgagctgagcccaagcggacgacctcgacaggatcccagaaagggtcgtcatctcgagccacagggccgtgatctccatctagaaagcgctggtaaagttcctgcattaggaatttcctattgatgaacttggcttttgaccatatccacacctggaaacacagaggaaagcagagagacacagtgtgaaatcgctgctctcagatcagcacacgggagaggccagcagtcaggagggggctcaccgagtttgtctgcactcgctccctccgcagccgccctctccagctggaagaagtcgtaatcgaacctgctcaggtcctcactgccccactccgaagaaaccccacgtacaggtgaggtcagaggagtgaagtgacttgcccaagaccacacagtgagtcaggagcaggcctgtccctccagcagtggtgccatgttgtccccaagccatggtggcagaggagctggtgtgaacgccccatcctgccacgtctgtgatgtgggcacctcacatgactgtcccctcccagctcttgggggggacctaggacattctgtgagcctgcaggaaagtttaccaaatgctgcagctttgtcctggtggtgatgggcaccccgttaacggcaaccttgcatttgctatgtggagtgaccgtcactttaccgtcggcatttgtgaaggaagcgtgtttatctgaaattctaagaagatgagagtcaaagacacccagcaaacggcggtttccgtgagcagggttggagcccaggaagcaaaccagcactgcaccctagatttcagccagaggacgaaagccctgccctcagctttctcagaccagccctggagtaggtggcccggggagacctgggcagtgtccctgcttgtcctgcagactgtgtggctctgcagacctctagatggaggaggcacaattctctaatgctggacgaggacactgatcatggaaactcaccccaaaccttgaatcgtgatagcatttgaggcagcctgaccggtgccacatgaacctgaaaggaatcaagatataatttattttgaaaataaatcagacactttcaga

SEQ ID NO: 327917 - DNA, 1144 bp, Homo sapiens
tcagaaactccacttgctcctccagcttcatgcagtaggccagcgactggagccagatgtgagctgagcccaagcggacgacctcgacaggatcccagaaagggtcgtcatctcgagccacagggccgtgatctccatctagaaagcgctggtaaagttcctgcattaggaatttcctattgatgaacttggcttttgaccatatccacacctggaaacacagaggaaagcagagagacacagtgtgaaatcgctgctctcagatcagcacacgggagaggccagcagtcaggagggggctcaccgagtttgtctgcactcgctccctccgcagccgccctctccagctggaagaagtcgtaatcgaacctgctcaggtcctcactgccccactccgaagaaaccccacgtacaggtgaggtcagaggagtgaagtgacttgcccaagaccacacagtgagtcaggagcaggcctgtccctccagcagtggtgccatgttgtccccaagccatggtggcagaggagctggtgtgaacgccccatcctgccacgtctgtgatgtgggcacctcacatgactgtcccctcccagctcttgggggggacctaggacattctgtgagcctgcaggaaagtttaccaaatgctgcagctttgtcctggtggtgatgggcaccccgttaacggcaaccttgcatttgctatgtggagtgaccgtcactttaccgtcggcatttgtgaaggaagcgtgtttatctgaaattctaagaagatgagagtcaaagacacccagcaaacggcggtttccgtgagcagggttggagcccaggaagcaaaccagcactgcaccctagatttcagccagaggacgaaagccctgccctcagctttctcagaccagccctggagtaggtggcccggggagacctgggcagtgtccctgcttgtcctgcagactgtgtggctctgcagacctctagatggaggaggcacaattctctaatgctggacgaggacactgatcatggaaactcaccccaaaccttgaatcgtgatagcatttgaggcagcctgaccggtgccacatgaacctgaaaggaatcaagatataatttattttgaaaataaatcagacactttcaga

SEQ ID NO: 327918 - DNA, 2587 bp, Homo sapiens
aaaattggatggaaagaaattctgtgtgctcccaggattccagttccttaccggaggttggtgccgtctgagtctgaaaagctgccctcttgccgtgttcatgctttggtagaacaccttcagagccttggcaagctctcggtcagagccagcttgctgtgtgcacatttggctcatctccccggcggatggcagttgcacagtcatcccgctgatcttcagagtgttggaaggcttcggggctgaggtggaaaaaggtaacattgatttatgtatctctttctctgggcatctctatatttattttggtggcattctactgcatcagcatttatcaggcaccagtttggatccatccaagggaaaggggaaatctcacagggcagaagaaatgtccggcattttttgtttatgaaagaagatacgaattaactcatttaaaagtttgtttcttaaaagacaaatacacatcccaaatgtaggagtctagggataagctaaacagccaagactggagcagtctctcaccttgaccagaagcagttttcgcaagtgatgctttgagaagcacgttctcctctctcagggctctgttaatgttcctgagcggttccgtctcctgctctagcttgagcagcttcagataaagttctggtatctggtttgatgctgcctaccagaaaacatgtcagtttcgtcttttgttgtatcatctgcatatcctttgagactggcaatgtttgctaccatgggaaaatcaaatgggatgggagtgtgtgtatggtgagcagagtttaagcccctcagggtacacaggagtaaataaagaaaacgtttgttaagggggaaggaacgtcaagcagccgtcctcagagattttctagccacctgggatgcccactttagtgtcctatgtacacacctggcttatatccttcacagtggaaattttcttggtgtctaccaggatgtggccttcacctgtgaccatgaggcccagctgagagcagctcagctcggtgcagccttctgtaatggggagagacacagtcaaagaaagaaacatcccagtcgcccagctccagtgtcagcttcatgcagtaggccagcgactggagccagatgtgagctgagcccaagcggacgacctcgacaggatcccagaaagggtcgtcatctcgagccacagggccgtgatctccatctagaaagcgctggtaaagttcctgcattaggaatttcctattgatgaacttggcttttgaccatatccacacctggaaacacagaggaaagcagagagacacagtgtgaaatcgctgctctcagatcagcacacgggagaggccagcagtcaggagggggctcaccgagtttgtctgcactcgctccctccgcagccgccctctccagctggaagaagtcgtaatcgaacctgctcaggtcctcactgccccactccgaagaaaccccacgtacaggtgaggtcagaggagtgaagtgacttgcccaagaccacacagtgagtcaggagcaggcctgtccctccagcagtggtgccatgttgtccccaagccatggtggcagaggagctggtgtgaacgccccatcctgccacgtctgtgatgtgggcacctcacatgactgtcccctcccagctcttgggggggacctaggacattctgtgagcctgcaggaaagtttaccaaatgctgcagctttgtcctggtggtgatgggcaccccgttaacggcaaccttgcatttgctatgtggagtgaccgtcactttaccgtcggcatttgtgaaggaagcgtgtttatctgaaattctaagaagatgagagtcaaagacacccagcaaacggcggtttccgtgagcagggttggagcccaggaagcaaaccagcactgcaccctagatttcagccagaggacgaaagccctgccctcagctttctcagaccagccctggagtaggtggcccggggagacctgggcagtgtccctgcttgtcctgcagactgtgtggctctgcagacctctagatggaggaggcacaattctctaatgctggacgaggacactgatcatggaaactcaccccaaaccttgaatcgtgatagcatttgaggcagcctgaccggtgccacatgaacctgaaaggaatcaagatataatttattttgaaaataaatcagacactttcagaatttgagcgtaagaagttaacatgtctgatgcgttggaagtgacgttttctctacagtgggatggtactgaagggatttttccagttgggattttcaatcataatggtacttagacatacttttctttctgccttgtgtgtggggggaagagcggggatgttcctaacttttaaaaagttccaccttcttcatgagcattctggaggaagacaccattaggtctgggccttaggagacccactgaatactggccacagcagaggttctggtgtttgaagctccgtttctgtgtagtgactgaccccaaggagtgcagacatgtcaccccccacatccccacatcccacggccatctcgcacggagccctcccggccg

SEQ ID NO: 327919 - DNA, 1667 bp, Homo sapiens
  misc_feature (1378)..(1378): n is a, c, g, or t
aaaattggatggaaagaaattctgtgtgctcccaggattccagttccttaccggaggttggtgccgtctgagtctgaaaagctgccctcttgccgtgttcatgctttggtagaacaccttcagagccttggcaagctctcggtcagagccagcttgctgtgtgcacatttggctcatctccccggcggatggcagttgcacagtcatcccgctgatcttcagagtgttggaaggcttcggggctgaggtggaaaaaggtaacattgatttatgtatctctttctctgggcatctctatatttattttggtggcattctactgcatcagcatttatcaggcaccagtttggatccatccaagggaaaggggaaatctcacagggcagaagaaatgtccggcattttttgtttatgaaagaagatacgaattaactcatttaaaagtttgtttcttaaaagacaaatacacatcccaaatgtaggagtctagggataagctaaacagccaagactggagcagtctctcaccttgaccagaagcagttttcgcaagtgatgctttgagaagcacgttctcctctctcagggctctgttaatgttcctgagcggttccgtctcctgctctagcttgagcagcttcagataaagttctggtatctggtttgatgctgcctaccagaaaacatgtcagtttcgtcttttgttgtatcatctgcatatcctttgagactggcaatgtttgctaccatgggaaaatcaaatgggatgggagtgtgtgtatggtgagcagagtttaagcccctcagggtacacaggagtaaataaagaaaacgtttgttaagggggaaggaacgtcaagcagccgtcctcagagattttctagccacctgggatgcccactttagtgtcctatgtacacacctggcttatatccttcacagtggaaattttcttggtgtctaccaggatgtggccttcacctgtgaccatgaggcccagctgagagcagctcagctcggtgcagccttctgtaatggggagagacacagtcaaagaaagaaacatcccagtcgcccagctccagtgtcagcttcatgcagtaggccagcgactggagccagatgtgagctgagcccaagcggacgacctcgacaggatcccagaaagggtcgtcatctcgagccacagggccgtgatctccatctagaaagcgctggtaaagttcctgcattaggaatttcctattgatgaacttggcttttgaccatatccacacctggaaacacagaggggtccacacccagtgcacagcagatccaggacaacagcctgccgctgtcttcctcctcactgggtgaggacagggcctctgtcagnactggctctggagaggaaacaaacctgaagccacaggaggagggattccagagggattccaggtaggtcgtttttagaccataaatatcaggtaaaactagcaactccttttctgagcaactggaaaagcaaaagcaaaaatcagcagacaagtcgttccatgtatgatgtctcttcataaaaaggacattctcaggactctgaaaacagattccatctttgttggccacatgaacctgaaaggaatcaagatataatttattttgaaaataaatcagacactttcaga

SEQ ID NO: 327920 - DNA, 335 bp, Homo sapiens
gacattctcaggactctgaaaacagattccatctttgttggcctcaaagtgaagaaccgtagtgctctcctagaggcggcaccaccattaaataagaatgtgggggggcgggcgcggtggctcacggctgtaatcccagcactgtgggaggccgaggcgggcggatcacgaggtcaggagatcgagaccagcctggctaacagtgaaaccccgtctctaccaaaaatacaaaaaattagccgggagtgctggcgggcacctgtagtcccagctacttgggaggctgaggcaggagaacgctttaacccaggagatggagcttgcagggagccaag

SEQ ID NO: 327921 - DNA, 421 bp, Homo sapiens
ggtgccaaaaaaatgggcctctggcgctgcaccgccctccttcctgagctctgctttcacgcccattcttccttttgctcccgctctgctccagtcgggcctgatttctgagcagagtgacatgctctcctttctggtccatggattcagggatggactcgattgccagctttcaccctgaaagctctctggagtggtttgcccagctgtggccccctcacctggactgaccagctcctccccgctgttgacctccttcttgcaagaagggtgttgtttcaatgtgctttgcaagagtggggtggggtgaggaacaaggatgagataaaagagtgacaaaagagtagcagctagaaaaaggacaaaggtagtgtctacccacacatgtctttaccttatctaaaaatacttcccattggca

SEQ ID NO: 327922 - DNA, 206 bp, Homo sapiens
ttgccacctggtgtggaggtcaggagcgtgggctctgggccctgcctgttggttctaatcccagttctgctatttgctggctgaatggctgtggacaggggacttgcttggggccttggttttcccctctattaagtgggttcatatcagtacctacttggtaaggctcttgtgagggtccccaaacacccataaagtgccaaggt

SEQ ID NO: 327923 - DNA, 145 bp, Homo sapiens
catgtatgccaatatggaataaaacactatctcactgccttagctgcttagttgtgggtaaagctgaacatctttaataagggtttttaatcttttgaaatcaaacttctctaacttttcctttaacgacttctgtaacattttt

SEQ ID NO: 327924 - DNA, 680 bp, Homo sapiens
atccttagattccacaattttgcagattattattagaaatatcaatccattgactcatctatttgatactttatttcaacataccaaattaaaagactgctagaggtaggcacaatgtcaacagtagcaagtggctggccagaatgcctgaccacgaagaagaagtgtttaagcgcaatggcctgggactatttaatgctagtgcaaataaccttatccatgccaatggctcttgacagcatctttgctttgcaatccatgacaataactggtgttctttcataagactcttcctaagtcatctcagaaagttatgctcagcattcttctctaagaagacaaagcaaatatccatctaaaatgattgcaagttgtgtcattaatttcattataatgctacataagtaaaggtgcatatgcttccttgagattggccacttgtccatacacattgtattacagtccttacctggtcaattttatccaaatcatcttcctcagtttacctaaattttgtgagttgtttactcattttttttcctttctgctttggacagctttttttatttttcttttttttttatttccataggttttggggggaacaggtggtatttggttccccatataccaccaaataagtaagttctttagtggtgatttgtgagattttgctgcac

SEQ ID NO: 327925 - DNA, 308 bp, Homo sapiens
ccatcataagtctgttaaggatagactagttactatgtttttgtggatttttctaggaatacccaatactgaactgtaaacagtaagcacagttgggggatcagattcaagttgatggttggctcagaagacaatggtgctggattaaggagacatggatttgtataatatgaaaatgggtattggttaagtgtagcaataatcgaggcaggaggttattgatagccttagaaagcagagatggcaagcataactacttagtgatgttgaaggttcactgggaacagaggggagttggaagacaggga

SEQ ID NO: 327926 - DNA, 349 bp, Homo sapiens
tcaggggaggcttctcaggtccgaaggaggaggaagacttactaggagaagatgagcaaggtgtgggtagagaggattctgggcaaatgcaaaggccccatggtgggagagagcctaatgtgtttgaaaacctaaaaggaaggcatttggcatctggactggagcccagagacaaatgtggggtgagaggtgctgtagaggtaagtggcaccagaccatgcaaggccagttcaagttctgtctattcttatgacgcagctggttttgcagggtgggtgatgtagtgtgtgtgcaatttatttgtgtgtttgagggaaagacagatggtttggagaacagatttgagggg

SEQ ID NO: 327927 - DNA, 517 bp, Homo sapiens
tactactactgctcgaattcaagcttctaacgatgtacggggacatgttataagacaaatggacagggagggcatgatcgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataatttc

SEQ ID NO: 327928 - DNA, 481 bp, Homo sapiens
tactactactgctcgaattcaagcttctaacgatgtacggggagaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataatttc

SEQ ID NO: 327929 - DNA, 1932 bp, Homo sapiens
agcgggccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataatttc

SEQ ID NO: 327930 - DNA, 1386 bp, Homo sapiens
agcgggccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatctta

SEQ ID NO: 327931 - DNA, 1649 bp, Homo sapiens
agcgggccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatca

SEQ ID NO: 327932 - DNA, 1664 bp, Homo sapiens
  misc_feature (1095)..(1095): n is a, c, g, or t
  misc_feature (1112)..(1112): n is a, c, g, or t
  misc_feature (1116)..(1116): n is a, c, g, or t
  misc_feature (1128)..(1128): n is a, c, g, or t
  misc_feature (1130)..(1130): n is a, c, g, or t
  misc_feature (1132)..(1132): n is a, c, g, or t
  misc_feature (1136)..(1136): n is a, c, g, or t
  misc_feature (1138)..(1138): n is a, c, g, or t
  misc_feature (1140)..(1140): n is a, c, g, or t
  misc_feature (1143)..(1143): n is a, c, g, or t
  misc_feature (1149)..(1149): n is a, c, g, or t
  misc_feature (1155)..(1155): n is a, c, g, or t
  misc_feature (1158)..(1158): n is a, c, g, or t
  misc_feature (1163)..(1163): n is a, c, g, or t
  misc_feature (1170)..(1170): n is a, c, g, or t
  misc_feature (1173)..(1173): n is a, c, g, or t
  misc_feature (1175)..(1175): n is a, c, g, or t
  misc_feature (1178)..(1179): n is a, c, g, or t
  misc_feature (1190)..(1190): n is a, c, g, or t
  misc_feature (1193)..(1193): n is a, c, g, or t
agcgggccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggaaaaaaaaaaaaatgaaaaaaaanaaataatataaataaanaaanaaaaaaagaaanananaaanananaanaatganaaaaanaanaaaanaaaaaanaananaannagaaaaataanaanaataaattttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatca

SEQ ID NO: 327933 - DNA, 584 bp, Homo sapiens
agaggaggggccaggagacagcacaacagcaaaggctacagagtcatgggttcagagttcagaggaggggccaggagacagcgcgacagcaaaggctacagagacacggggtcagagttcagaggaggggccaggagacagcacaacagcaaaggctacagagacatgggttcagagttcagaggagggcccaggagacagcgcgacagcaaaggctacagagacacgggcatctttgaggaagagaatgggatagaaggacagggaggaagtctaactggttccagcccacagacggcccatagcacagcagcagagccgcctggggaagtgaccgctgcaagactcctagactcggaaaggaggggggcgagacggaatcacagggagaaatgtcacccaaacttcgagctttgaatccatttaatgactggtcattttccaagaactttctgaagcttcatggtttctaactgtattttcaaactgcccatacggcccttgtgacaggggctgcgggggagtgggggtgcatctgaattcactgtgcgaactcgaacccagtgtggcgatcctctagatca

SEQ ID NO: 327934 - DNA, 149 bp, Homo sapiens
acaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtctt

SEQ ID NO: 327935 - DNA, 902 bp, Homo sapiens
ctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcagccagtaaaaaaaaaaaaa

SEQ ID NO: 327936 - DNA, 989 bp, Homo sapiens
  misc_feature (29)..(29): n is a, c, g, or t
  misc_feature (811)..(811): n is a, c, g, or t
aaacataggctaggtacgaggctgggtgntaatcggccgagggaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccagtcgaaaggaaggtaagaantgccttaactggtgaatgtccgtgggttttgtctcaaaattggataacaatttttcaaaaaaaaaaaaaaaaaagaccgaaaatacagggagaaaaacaaagagaaagattttaataagtatagtgtggaaaaagagaaggtggccaccacacatttttgtttttatttcagacgaac

SEQ ID NO: 327937 - DNA, 917 bp, Homo sapiens
  misc_feature (29)..(29): n is a, c, g, or t
aaacataggctaggtacgaggctgggtgntaatcggccgagggaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcagccagtaaaaaaaaaaaaa

SEQ ID NO: 327938 - DNA, 800 bp, Homo sapiens
ctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggtctggtctaagctgggtcgatgccagtcgaaggaagtatgcctaacggtgtacgagatgtgt

SEQ ID NO: 327939 - DNA, 1037 bp, Homo sapiens
ctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtgtgggcagcgctgcccacgaagtgtacctccacactcttgacacaccagctcttgtggaccctcggaccactgcacgcaggctaagcacagggctagagactggccgagcatggggccaggtcctgagcagctgctgcctggaatgactgctcttcccagcacttccccagctgtctccctggcttctttcagatcacgactttcgtgcgttacactcctcagaaacgtagcccgtgggtcgtgtgctccacctctaccaaattctggcattcctcttcactacaccccacttcgtgcagg

SEQ ID NO: 327940 - DNA, 1003 bp, Homo sapiens
  misc_feature (838)..(838): n is a, c, g, or t
  misc_feature (844)..(844): n is a, c, g, or t
  misc_feature (961)..(961): n is a, c, g, or t
ctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtccctggagaantctggnacatacatactccgaccataccaatttcctcagcagggaacaaacaaaaaaaaccggggacaaagcgggggcggaaaagggatcaaagcgacggcacacggtcagaccatctgcaanaggaacggcgcccaaggggagatacgacacccatcagcgcag

SEQ ID NO: 327941 - DNA, 1052 bp, Homo sapiens
  misc_feature (29)..(29): n is a, c, g, or t
aaacataggctaggtacgaggctgggtgntaatcggccgagggaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtgtgggcagcgctgcccacgaagtgtacctccacactcttgacacaccagctcttgtggaccctcggaccactgcacgcaggctaagcacagggctagagactggccgagcatggggccaggtcctgagcagctgctgcctggaatgactgctcttcccagcacttccccagctgtctccctggcttctttcagatcacgactttcgtgcgttacactcctcagaaacgtagcccgtgggtcgtgtgctccacctctaccaaattctggcattcctcttcactacaccccacttcgtgcagg

SEQ ID NO: 327942 - DNA, 974 bp, Homo sapiens
  misc_feature (796)..(796): n is a, c, g, or t
ctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccagtcgaaaggaaggtaagaantgccttaactggtgaatgtccgtgggttttgtctcaaaattggataacaatttttcaaaaaaaaaaaaaaaaaagaccgaaaatacagggagaaaaacaaagagaaagattttaataagtatagtgtggaaaaagagaaggtggccaccacacatttttgtttttatttcagacgaac

SEQ ID NO: 327943 - DNA, 406 bp, Homo sapiens
agtaaaattcacagggaataatcctgcattcaaatacctctcttacagtcaagtctgcctttatcttggctgttctggctgaagtttatagcactttttcctgttaaaatgaatgtgagggactttccagattcttttgttttactggaattaggctttgaaataataggttatttattagtccagaatgttttcttatcctgagaatttctggtacacaaattattcttaaaacagaaaagtatttttatgttttgaaagaaaaattttacatttgaagaggatttaaataaataaattataacaatattcttgattccaagaactttagataatagtatttcttctgagatatgagagaaaaagtgttcaagttgttagggaagcagcttgttttttagtgcat

SEQ ID NO: 327944 - DNA, 220 bp, Homo sapiens
tatacagaaattaaatagattttgtatgttgatattgtaccctgtgaccttgctgaactcacttgttaattctaggaggtttttgtatagatttcttggggttttctatggaggccatcatatcatctgcaaataaggatagttttatttattgtttttataccaatgccttatatttctttttcttgtcttatcgtgctggctggaacttccaatatgt

SEQ ID NO: 327945 - DNA, 900 bp, Homo sapiens
tgttacgcgagaatcgcagatattggggaattggttgagtggaaggtttatagccagagcaaacggttatatataatgctcatagcgcgactatagcagtaacaattagcaatgcaagagaaaaactagctgaccagattcgttcacactctaattttctactcactcgcttatgtaatcccaacgttttatgtcctcgatcttctttccctggctcgcttacgctgccacggtgacgcgtacagaaagcacgggaaacaataagattggaaagtgaaaaagactgggtggtagtgttttacaattacatcaccattagtaataagggatagttgatatgagtagtaacacccggatttttgggaataatgacacacacctggtctgggacgtgatagaattgctgaatgatgaaaggaaattttaatttttattgggttccaaggaccaccaatagaaaataagattaaatatgcggtattcttgacattacatccgtcctaagaggtgaagtatttttgatccggggaaaacatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaataatatgaacacttcagttcttaaacattgacaatgtatatactggatgtaataaaacgggatgctgtcaagaggatctggctcttgcaataacatacggatcgtctgtattataaa

SEQ ID NO: 327946 - DNA, 886 bp, Homo sapiens
catagttagtggttggttctaccgagcgaagtttgacttggagggaacatgggaccagggacacctgcggctccaggtcagagatgcacctgctagtcctgcctctacaggacccaacccatcagttcctagcttgtccttctggtgagaattgagcacactatactgtggacataaagacaaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatggggaaccaccttgagggggagactggcgctataggaggagaaaacgagtgggagggcgacagggggacggagaaaaggagcgagcgagagatcgaagcctgcgcgtgctaggcactgactagtagagagctcagaagggaggagccggcaaccgacagaaccatttatgaaaagtggtggatggtagtggcatactgagtcatctggcgggatgcgtagtcgcgggtccctttaatactatagtatattgataagcgagatagggcaagttgacgcgggtggcgtttgaaccgttctgggtagtctgcgatattgtgactcaagtcctcagagtggcataccgcgtccccctatgctcgcgagtccaaaaaacgtgaggatagggcgcggg

SEQ ID NO: 327947 - DNA, 918 bp, Homo sapiens
caaccaacgcggcattcgtgccccgatcgcgaacgccggtggtgacatccgttctacatacgctcaccctcctcaccttccgctcggtcacaaatcacccactcaactctaaacatcgacacgatctgtgtataagcaaattggatctatatcagaaacctctaaacatgttcggttcgagggcattggtatgatcaagcggccggacatcccgtacttctcttggcccaaaaggcacgaacctggtaagctgtccagagtgaggaacccaagggacacctgcggctccaggtcagagatgcacctgctagtcctgcctctacaggacccaacccatcagttcctagcttgtccttctggtgagaattgagcacactatactgtggacataaagacaaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaataatatgaacacttcagttcttaaacattgacaatgtatatactggatgtaataaaacgggatgctgtcaagaggatctggctcttgcaataacatacggatcgtctgtattataaa

SEQ ID NO: 327948 - DNA, 894 bp, Homo sapiens
gtgtttgatggtacaggcgctaatgcgatcatctcctgttacaacgacgaaaatgccgacttccccgtcacctgcgcggccccccagcccccacttcaaactcaaactccagggacatggctgcgtaaggccattgaccccccgcctaaaccccccaaatttttttggcagcccttggataaaacccgggtgggaatccaagaatttttggcccaaaaggcccgaagccgtcagtgttcccaaagaaggggacacctgcggctccaggtcagagatgcacctgctagtcctgcctctacaggacccaacccatcagttcctagcttgtccttctggtgagaattgagcacactatactgtggacataaagacaaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaataatatgaacacttcagttcttaaacattgacaatgtatatactggatgtaataaaacgggatgctgtcaagaggatctggctcttgcaataacatacggatcgtctgtattataaa

SEQ ID NO: 327949 - DNA, 871 bp, Homo sapiens
aggatagagaaaatatataatggcgggggttcactgaaggtataacaagaggaggatgcacaacataaagatatggtaagaggaccatggctactcggaggcggaggccccgcaaggtcctaatacacaccattgctatccaccccgggtggaataccaaccccttccgtggccctagaggcgcagactggtcagttgttcaaacaaaggatccaggtacgcccatggacacctgcggctccaggtcagagatgcacctgctagtcctgcctctacaggacccaacccatcagttcctagcttgtccttctggtgagaattgagcacactatactgtggacataaagacaaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaataatatgaacacttcagttcttaaacattgacaatgtatatactggatgtaataaaacgggatgctgtcaagaggatctggctcttgcaataacatacggatcgtctgtattataaa

SEQ ID NO: 327950 - DNA, 1140 bp, Homo sapiens
caaccaacgcggcattcgtgccccgatcgcgaacgccggtggtgacatccgttctacatacgctcaccctcctcaccttccgctcggtcacaaatcacccactcaactctaaacatcgacacgatctgtgtataagcaaattggatctatatcagaaacctctaaacatgttcggttcgagggcattggtatgatcaagcggccggacatcccgtacttctcttggcccaaaaggcacgaacctggtaagctgtccagagtgaggaacccaagggacacctgcggctccaggtcagagatgcacctgctagtcctgcctctacaggacccaacccatcagttcctagcttgtccttctggtgagaattgagcacactatactgtggacataaagacaaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcattgggggagtggaaaaactgagccgatcgaaggttgtgaacccttggaggtgttaagcattgagcatgacgttagcaggatggaatcaagagaccattcacacgcttgactcttgagggaggggggattaggatgagactggagtaagttgactaagcaagccaccgaaaagtttgacaaagaagccatggggacaagatcactaaacactgcactccccgctcccccctgtgtacgcgcagtgaagactgtaagcaccggtataggagaacacctctctttggctactcggcctcaccagcatacgagttatacgcgcctcaagtatcgccctcgactctgtctccgtaattagccacacgccaatca

SEQ ID NO: 327951 - DNA, 946 bp, Homo sapiens
gccgcatgcggcgtattgcggcgatacgcgctaatcactatcggtccccatccacactaactcgacccttcatcgtatcccactacacatcccttcaacccccttgctcctttaccttacatcctctacttgacccctcgctctcctctattgctccttcttgctcccatcatcacatgggcagactgttcttcctcgccccccatcgcatctactctccgtgactttctccctcgcttttcttgccgatcagcgccctcggcccgcgccctgtccaacagcgagggaataaagacacactttcaggtataaattcataggtggcacatatatatcattgcctttacaggcacccaacccaatcagttcccgctatgtccttcgtggtgagattggagcacccctcactgaggacataaaaaacgaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaataatatgaacacttcagttcttaaacattgacaatgtatatactggatgtaataaaacgggatgctgtcaagaggatctggctcttgcaataacatacggatcgtctgtattataaa

SEQ ID NO: 327952 - DNA, 1098 bp, Homo sapiens
caaccaacgcggcattcgtgccccgatcgcgaacgccggtggtgacatccgttctacatacgctcaccctcctcaccttccgctcggtcacaaatcacccactcaactctaaacatcgacacgatctgtgtataagcaaattggatctatatcagaaacctctaaacatgttcggttcgagggcattggtatgatcaagcggccggacatcccgtacttctcttggcccaaaaggcacgaacctggtaagctgtccagagtgaggaacccaagggacacctgcggctccaggtcagagatgcacctgctagtcctgcctctacaggacccaacccatcagttcctagcttgtccttctggtgagaattgagcacactatactgtggacataaagacaaaccttgctggaactgactggtggaatgtagcaggaatcggagggaagctttactcatcattccagtccagggaccaacataggaaattatattaaaattggttcttctctgcttacttccgtcctctagttgcatattcttaatcaggtaaagcatttgttaaccttgtttttaatacttagaggagtgccctggagcctgtctgccctcatgattgtctggagaggtgagaagaccaggagtagtaaaacagaccaaagatttcccaatttctcttggggaagtggctgggattggggatggtggccaatgggagcccaactttattggtaaaattctgattattttatgagaagaatgtatttttgtatcatttgtgtaattaaaaaattaagcaaatgaatatttggaccctgaagtgttgaactttgccattggtatgaccggatggttaagaccgatccgcccctggcctctgatgagggtaattgataatcctggtcacttgctcattgcggttgggcacgtgtttgtgggtatcggattatgtccttgagtgcgtgggtccggttggcctgcatggggggtttctccagaaaaacatgggaggaatgccgcggtaggcggccgcccccgaaagcctggatagctccatctcactaggtccctgagcggagtgctcggagaaagaaccgcagag

SEQ ID NO: 327953 - DNA, 761 bp, Homo sapiens
tttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatg

SEQ ID NO: 327954 - DNA, 4340 bp, Homo sapiens
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 327955 - DNA, 4155 bp, Homo sapiens
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaagggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 327956 - DNA, 3052 bp, Homo sapiens
agcagggccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaagggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 327957 - DNA, 3269 bp, Homo sapiens
tccaccatgattgtgagatctccccagccacgtggagctcttgaagaacttcctttaacatctcttatggaatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaagggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 327958 - DNA, 4367 bp, Homo sapiens
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtaagcaggaccagccacctctaagcaccccagggggcccagggcagagtctgcacctacgctggtcctgccaatgtccacaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 327959 - DNA, 228 bp, Homo sapiens
aatggtttgctctcttactacaggtatggaagcgccagggtgggacatgggggttggagggtggtgatgctgcagggatggtgatggagggcctccatggttggcggacactgccactagtctagagatgtttaggggcatgcattccagcaggccaagtcacgcttctggcccgccgccaagggccgggggccctgacctctggcaagggtgaatgtgatctgcgga

SEQ ID NO: 327960 - DNA, 359 bp, Homo sapiens
tgacccacatgttgagagatcgggggggcttccagaaagaggctcctgtgcggtgaatgcgttgaaagcacatgattctagcagagggagcaagggtggccgcagcccagggaatcagggctgcccaggtgactgaagcaggaggggagtgaggccagatgggggttgggggagcccttggctctggacttagggaggcgagattgagccttttgtgaggttacaaattaaagctctgtctgtgtctctaggaagcctcttgactcccaaaggagaggacagtgaggaagatgaagataccgagtactttgatgccatggaagactccacatccttcatcaccgtgatcaccgaggcca

SEQ ID NO: 327961 - DNA, 404 bp, Homo sapiens
gcgggtagggggcttcaggtcagcccgtctctcctcctgctcacagctgagcacgagtctcctggccccaggtagagttgtcacacagcctcagagaaatgagaccacgttcaggcctgggctgggtcagccaggccctccctgggcccctgggaacctccccctgccagtccctctgccgggccccaagcctaatccagcttatcaagcacacagcacacagcccagctcagcattctgagaacagcagggccacgccaggcgcctgcctctccccacagcacagccaggatggggcctggagaaggccggcagcagcagaggagaccctgggagtcagggatggacaccaggtgggtgcatccgggctgggggaggtggacgggctctctgcatccatgggg

SEQ ID NO: 327962 - DNA, 415 bp, Homo sapiens
tgacataataatgcgtttgtatttccctgtccctcccagaagccactgccggaggcttcccaggcactgcctccctacccgagaccaaaactgctttgtcttgaataagcagttttggcttttccgagataatgagcgtctcagctggctgccgtcttgcacagtcttttatcagacatcagaggctcatctgtgtttacgaagccatcagaacagctccaagtttaagtgcctaatgaattgttttatgagaaacacaaccccctggggttggtcacgattcctttctgcagctccagcatccggggaacatggcggcagagtcagccctgagtgacggaagctgtgccctgggctgggttctgccaaacctgctggtgttagcctgccatgagggcccctccccaagctcctg

SEQ ID NO: 327963 - DNA, 707 bp, Homo sapiens
tgacctgtcccctgcctccaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtaagcaggaccagccacctctaagcaccccagggggcccagggcagagtctgcacctacgctggtcctgccaatgtccacaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccgtgagtagggctggcaggggccccgccacaggcaaaggagagggaaggaggacagtggacagaaagcaactgacaggcacaggaggtcgggagggttcagtccacacatgggcagagaacagtattatgcagccgacatcccagtgtgaaggcagacaccgaacagtaaataaatgtgaaactatcaaacactatgcacagactttaagcgaggtgat

SEQ ID NO: 327964 - DNA, 3279 bp, Homo sapiens
cggcggcagcagcagcagctgcaagagccctcgcagcctcggggcaggacccacgtccacacccgagagcccctccctgggatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaagggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 327965 - DNA, 3051 bp, Homo sapiens
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctcccgtaacagttggcatttgtttgtgtgtgtgtgtgtgtgtgtgtgtgtgtgttttaag

SEQ ID NO: 327966 - DNA, 1427 bp, Homo sapiens
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgccgcactccagcgctccctgacagagctggacggcctcaagatcccatctgagagtggggagaagctgaaggtggtgaatgagcgggccaccctcttccgcatcacatccaatgctatgatcaacaagccactgccggaggcttcccaggcactgcctccctacccgagaccaaaactgctttgtcttgaataagcagttttggcttttccgagataatgagcgtctcagctggctgccgtcttgcacagtcttttatcagacatcagaggctcatctgtgtttacgaagccatcagaacagctccaagtttaagtgcctaatgaattgttttatgagaaa

SEQ ID NO: 327967 - DNA, 381 bp, Homo sapiens
caaacttcccataaatttaaaatctgactgtaaggcattaaaataaatccgtttaaacaaggtaaatacatttttccttatgttgaaaaagtaaaaaaagaatgggaattggaaaaacattttttgcttgctttagggtgacagaatataactttccctaccagtttttgtggctaaaaggcaaaaagtaatacagtccactattaaggaacttaagattaagattttaataattttttttttttttttaaacagacagggtctcactctgttgcctaggctggtctcaaactcctggcctcaagcaatccttccgccttggcctcccaaagtgctgggattacaggcgtgagctactgtgcatggccaggaaaaccttct

SEQ ID NO: 327968 - DNA, 450 bp, Homo sapiens
cagcatttgacagcgaggaattgggcacagagaggttaagtcatctgccagtggtctcataactaggaaatggtggagccagggttggaagcaatgcaacagcttgtgttgtctcaaatgaaatgctttctgtggttcctaggcttacagggaatgactaagacattgtttggcctcaaaaaagcaactaataatttgtgtatttatttctgttaactgtatacttatttttgttaacttatttcatgtctctcctgctaccctataagcttcctgaaagccaagtttatcttctttttgctcacctatatattctttgctggaaaagcaccataaggtgcttagttattgttggccgaatgaatgaatagcttaatcataataggagaagtctctcagaagtcacttttgtccccttgcagctctatggcagactgagctcagtaaggc

SEQ ID NO: 327969 - DNA, 447 bp, Homo sapiens
aggcagtatttgataaacagttggaaagtgatatgtatccaggcagcagattaatgtgaggccaaagcatggaaagtgagttcctgctgcagccccctggaggtgtcacgttaggggagaactttgtctccaggagctgccaccaggaccctttcaaatcttgccattgaatttagcctggcatccaggtttctttgtgatgggtcccttttcagccacatcttccactacaacattctgctgccccagaatgtcactcattccctgaacatacttttcttccttgtgggcgtgctgagagggtttcctcctccacggccccaaatcccaccccttcctcagtgccctcctccataaaaccatcagttctgactaagttctctgtcctgtgaagtcctcgtgtggacttactctcctgctgaatgcacgtttacttttctgaatggc

SEQ ID NO: 327970 - DNA, 800 bp, Homo sapiens
gcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaacttcttatttacctcctagggaaagtgttgcccttatgccacatataatagcaaattgctttttttatggcatgcataacctagatgggaaaaaatatggcgcttcggggaaggagggaaaaa

SEQ ID NO: 327971 - DNA, 654 bp, Homo sapiens
taaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttcttgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacata

SEQ ID NO: 327972 - DNA, 567 bp, Homo sapiens
tcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttcttgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgcc

SEQ ID NO: 327973 - DNA, 758 bp, Homo sapiens
taaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttcttgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacataacaaaaacacaccctccctctcccctaccactctctcccctccctccaaaaaaaaaacctcaggggggggcccggacccaaattcgcctttagggagccgtata

SEQ ID NO: 327974 - DNA, 337 bp, Homo sapiens
  misc_feature (1)..(1): n is a, c, g, or t
  misc_feature (287)..(289): n is a, c, g, or t
  misc_feature (321)..(321): n is a, c, g, or t
nacgctgggcgatcaacccataagttttttgaatgaggattttaacctgtatcatagggtgaagatgaagccatgtttgtagaatatagaaaacaactgaagttactgttggacaggcttgctcaagtttcaccagagttactactggcctctgttcgcagagtttttagttctacactgcagtaagtttgtcattacttttgtaacaagcctacttctttcttttgctctttgatatgggtcaaaataaatgattcatatgacttattaatccatgttacttattnnnatcttatgtgtatctctggaaacaatgcacangtcttcttgatttatc

SEQ ID NO: 327975 - DNA, 393 bp, Homo sapiens
tgatagggaagatgtttataaattcttctgtgggatcagagggcacgcctattacaaccagaaaactacaagtataacagcgaggatggatgaacaggctctattagggctaaatccaaatgctgattcagactttagacaaagggtaagttactctgctgaatcattttttaatcatgtcaccacagattggcattagaggacttgaatataaatgcacttggcaaatttttactttgggtagaaatgaacagatacttttaaatttgaggtatttgaatatattttgaatatagaaacagtgagtgttgtgatttattttctgtttacttggccaaacaaaagtattaaaatctatatgattcaaggcagtgaagccgtagtaggcagtga

SEQ ID NO: 327976 - DNA, 3481 bp, Homo sapiens
  misc_feature (3292)..(3292): n is a, c, g, or t
tgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcagtctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttganaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtg

SEQ ID NO: 327977 - DNA, 3470 bp, Homo sapiens
  misc_feature (3281)..(3281): n is a, c, g, or t
tgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaacaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttganaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtg

SEQ ID NO: 327978 - DNA, 3524 bp, Homo sapiens
  misc_feature (3335)..(3335): n is a, c, g, or t
tgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttganaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtg

SEQ ID NO: 327979 - DNA, 1315 bp, Homo sapiens
tgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacaggtaagtttttgttttattctttttgctcaatacataatacaaaggagccatggagaagtggaaaatatggaaaaattaaaaatgagaaaatacccataattctactacctaaagatatttactgttaaatactaatgtatttccatctta

SEQ ID NO: 327980 - DNA, 586 bp, Homo sapiens
ccggcggtggtgtgaggacagagctggctgaagccaggctggggtagacacagggcagtaggttccccaccgtgaccgaccatcccctctaaccgtctgccacacagcgggggctcccgggaggtaggggaggtggccagaccggtggggggctccgccatgccgtgcaaatgctcagggccgcctcaccctccatctggccccagcccatgccggccttccctctggggagcgacttttccagaaggccggccaggcgagagggtcttcctgacggcggagctgacctgcccggcccaccagctgcatgtcagctccgagccaccgggtccccgtccaaggctgctctgctaagttaaagacacccgaaagcgcttgactcaggtccccggagtccctggccagggccccagcccctcgcttgccctgcactgtgtggactctggggatgcaggtgtaaggggagtgtggctgggcagcccctggtcagccagggtcacgcctgtcctgggggccccaccctgctgcccgacaccccccatgggaggctgcgggcggcagttgctgtctcagagaggggagtgtg

SEQ ID NO: 327981 - DNA, 619 bp, Homo sapiens
tctcaagaaaggcctactgatgagtgagctgatgctctcaatgactctgaatttttttttaatttaggataaattgattaaatataacataaaagtaatgtcagctacaataaactttgtaatgatggagaaattagccctggtaaatggaattatagttcaaactttctaatcaaggtagtatttgtcagtactattaaaataaaaccaaaataacaagaaaaccttaggagttaaatggaaaacatgttttccaccttttcatgcgtctataccccttgagctattttctaagaaacgcatactcttcagtataccctgggtaaagtagccagacacttcatttaaaacaaataaatcatggcccggcacagtgcctcacgcctgtaatcccagcactttgggaggccaaggcgggccgatcacctgagatcaggagtttgagaccagcctggccaacatggtgaatgaaaccctgtctctactaaaaacacaaaaattaatcgggcgtggtggcaggtgcctgtaatcccagctacttgggaggttgaggcaggagaatcgcttgaacccgggaggcagaggttgcagtgagcggagatcatgccactacactcca

SEQ ID NO: 327982 - DNA, 838 bp, Homo sapiens
aagtggcaacaccattttacattcccactactaatgtacaaaggttctgtattagtctgttctcatgctgctaataaagacatagccatgactgggtaatttataaaggaaagaggcttaatggactcacagatccacatgactagggaggcctcacgatcatggtagaaggcaaagtagaagcaattttactgtgttacatggcagcaagcaagagggcgtgtgcaggggaactcccctttataaatctgatctcacatcagatcttgtgagacttattcactatcacaagaacagcacaggaaagacctgctcccatgattcaattacctcccactgggtccctcccatgacacgtggaattatgggagctacaattcaagatgagatttgggtggggacacagccaaacggtatcaggttccaattgctctgtatcctcaccaacacttatttttcttttttattatagccatcctactagttgtaaatggttttgacttgaattttttctaatggctaatgatgttgagtgtcattactcttttatgtacttattggccatttgtatatcttctttggagaaataactattccaaccctttgaccatttttaaattaggttgtatttatttatttatttatttatttatttattagaggcagatgacaagaccccataataaaaaaattagcagggtgtggtggtgtccaactgtggttccagccacttgggaggctgagatgggaaaatcacctgagtccaggaggtcaaggctgcagtgagctgtgattgtaccattgcactccagcctgggcgacatggcaaaccctgtct

SEQ ID NO: 327983 - DNA, 2894 bp, Homo sapiens
ggaattcggcacgagggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtaaagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatcttttttt

SEQ ID NO: 327984 - DNA, 137 bp, Homo sapiens
taggtactgtggggcagtggctagaatactttaattttgctccccattgtgattctcatcctggctttgagttttgcttccctttgtgtcctgtggtggatcctccctccaggcagactggcctgcttgctctctgg

SEQ ID NO: 327985 - DNA, 2968 bp, Homo sapiens
ggaattcggcacgagggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtaaagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaaaaaaaagta

SEQ ID NO: 327986 - DNA, 2423 bp, Homo sapiens
agactgttcgaccagggttggcagtggtcgaatccagtagaaagctggtcaagggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtaaagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaaaaaaaagta

SEQ ID NO: 327987 - DNA, 2688 bp, Homo sapiens
acgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgattggatttgtaagtgaacttgtttgcatattgagtatattcttggtgaaagaagcagagaattaatgcaattctgtggcctcttcttcctgatgacatccttcctttcccagatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtaaagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaaaaaaaagta

SEQ ID NO: 327988 - DNA, 1488 bp, Homo sapiens
ggaattcggcacgagggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcagggtaagcagaagattctccttggcctcttcttgatgcttgctgaagtacagatgcgtgttactg

SEQ ID NO: 327989 - DNA, 416 bp, Homo sapiens
gcactagggcatgagtgggaatggaaaggtttcagagcctcctactcatcgctgctttcatttttagcaaacatctgagtgtcttgacttctaaacattagtcttgtgtgttaaaagaaatttgtttgcattgggccacattatactttgacccttaaaaagagactgatgaatatgtataattttgcacccttctgagcatttgagacttggcaagttcagtgaatacttactaatctcccatgtcctgctaggtactgtggggcagtggctagaatactttaattttgctccccattgtgattctcatcctggctttgagttttgcttccctttgtgtcctgtggtggatcctccctccaggcagactggcctgcttgctctctggaacatgttgtttgtttctaccactgtac

SEQ ID NO: 327990 - DNA, 381 bp, Homo sapiens
cttctcatatgaggccttccagcagaagatactgcgcttcctggagagccacctggatgacgccgagccctacctcctcacggctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgctgtcattatttgtatcaaaaacaaagaattgaaaaggcttcaaaaatttgaaaaacatattcca

SEQ ID NO: 327991 - DNA, 2930 bp, Homo sapiens
ggaattcggcacgagggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccgctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtaaagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaaaaaaaagta

SEQ ID NO: 327992 - DNA, 1786 bp, Homo sapiens
ggaattcggcacgagggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaagtatgaagaccttctttgtagaaattttggggctggttggtggtcctggttgggcctggtattacttccgtgaatgaagtaactttcagctaagttactcaccaccaaggcttgctcagactgctagaacttgacgcaggagtggccagtgacgacgtagccatccctgccggttctgaagccccgcatgtgggcttccaagccttgcactagggcatgagtgggaatggaaaggtttcagagcctcctactcatcgctgctttcatttttagcaaacatctgagtgtcttgacttctaaacattagtcttgtgtgttaaaagaaatttgtttgcattgggccacattatactttgacccttaaaaagagactgatgaatatgtataattttgcacccttctgagcatttgagacttggcaagttcagtgaatacttactaatctcc

SEQ ID NO: 327993 - DNA, 275 bp, Homo sapiens
gtctcagcactgggtgcatcgtcccacaggaatgacacctagacacccaacatacaactgcagggccctaaactatgggccagcccacccctaaatgcccttctctctacccttgcccatatcaaatattacaagcctctcacacatatttaccagtcatactgggaaaaaaatagtcctttatcattttaacatttcacaagtaactaaaacaaataataaacatgctaacacttgggaatggtctatttcttttctttttttttttttttgag

SEQ ID NO: 327994 - DNA, 344 bp, Homo sapiens
cagaaagaggtctccactcagacccagcgagaggcttcttggatgtcgcgtaggaaagaattcggggcgagtccacggactaaagtgaaagcaagtgtattagagaagtgagaaagcaaaagaatggcagagcagggcattcctgaaagcgggaggaggaaggcgcccgccttaggtacagtgcttgttcaaatctaaggtaacacagccaaagaaatcttgggggacatgggctctaccacgagggcccacgaccaaggtttcatgcgcgtccgtgtgaagagaccaccaaacaggatttgtgtgagcaacatggctgtttatttcacctgggtgcaggcggg

SEQ ID NO: 327995 - DNA, 438 bp, Homo sapiens
tgcatcccacatcgtcaagccaagatctgtcccacgaaacatttccagttatgtgatgggtgtgtgggtctcggactgttccaggaagtgtggtctgtgttggtcgggggctcacagccgtgaagaggctagtccggctgctcaggactgggagggaggctggagaatgtctgccaggctcttctgctctccaggaagagtggaggtgcctcagttagtggggatacgtgggatggggaggggctgctagagcactgccctggaggtggaggtgggtcagccaggccggtgcagacaggaggaagggcctgtggccctcgtggggtccggctcgagggactggacttgtttggggaagtctaggccttctgtttggacgggtctcatttgggatcacctttcagcacccacggggagacatgggtgtgacggggtgtg

SEQ ID NO: 327996 - DNA, 2486 bp, Homo sapiens
  misc_feature (1904)..(1904): n is a, c, g, or t
  misc_feature (1906)..(1906): n is a, c, g, or t
  misc_feature (1908)..(1909): n is a, c, g, or t
  misc_feature (1942)..(1942): n is a, c, g, or t
  misc_feature (1953)..(1953): n is a, c, g, or t
  misc_feature (1960)..(1960): n is a, c, g, or t
ggagtccagtgctggaggggcaggacggcggcggcgcagctcggaacccgccaggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctaaccaatcccaaaatcagaccagattggcctgccagaacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatcnantnnccaccaccgtgcgggacatcatgaaccgtggancctgcagatgngcttccnggtatcacggtgggataccagcacgggggaaccctttacccaggaaagaatttcctcctttgaacccggatcccaatggtacccggccctcaaattcagtacgtgtggattgtgcccattaaatccattcgagatggcagacagacagcgggactctggggtggtaagtgggaaaagccaaacggaccttcaggcatcaggcagagtggggcctagcggaaccacaatgtgatgaggcaatcccggggagccaacacaagaaactgttataacacacactggccggagcaagaacactgcgcaccacgatgtataggggagacaaaaatagaactaacaacggagccagacgacagtactgcaggtgcacaccaccacttgtaggtaagacacgcagcagcagcgacagagactagctgcacacgtgcacagccaaacagcatcgtactgcatcgcagcggtcgcgcgctacgatcgtatcttgcagagctgagtgacgagcgaagcaagaccgcacgagcggagc

SEQ ID NO: 327997 - DNA, 2526 bp, Homo sapiens
  misc_feature (1944)..(1944): n is a, c, g, or t
  misc_feature (1946)..(1946): n is a, c, g, or t
  misc_feature (1948)..(1949): n is a, c, g, or t
  misc_feature (1982)..(1982): n is a, c, g, or t
  misc_feature (1993)..(1993): n is a, c, g, or t
  misc_feature (2000)..(2000): n is a, c, g, or t
gagcgacagagcgagactctgtctcaaaaacaaataaaggaaaaagaaaaaaatgagaagcgcgtgttcccgactccggtgctttttcgcaaggtcgtgctactgcgccttctgaactacgagtcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctaaccaatcccaaaatcagaccagattggcctgccagaacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatcnantnnccaccaccgtgcgggacatcatgaaccgtggancctgcagatgngcttccnggtatcacggtgggataccagcacgggggaaccctttacccaggaaagaatttcctcctttgaacccggatcccaatggtacccggccctcaaattcagtacgtgtggattgtgcccattaaatccattcgagatggcagacagacagcgggactctggggtggtaagtgggaaaagccaaacggaccttcaggcatcaggcagagtggggcctagcggaaccacaatgtgatgaggcaatcccggggagccaacacaagaaactgttataacacacactggccggagcaagaacactgcgcaccacgatgtataggggagacaaaaatagaactaacaacggagccagacgacagtactgcaggtgcacaccaccacttgtaggtaagacacgcagcagcagcgacagagactagctgcacacgtgcacagccaaacagcatcgtactgcatcgcagcggtcgcgcgctacgatcgtatcttgcagagctgagtgacgagcgaagcaagaccgcacgagcggagc

SEQ ID NO: 327998 - DNA, 2431 bp, Homo sapiens
  misc_feature (1849)..(1849): n is a, c, g, or t
  misc_feature (1851)..(1851): n is a, c, g, or t
  misc_feature (1853)..(1854): n is a, c, g, or t
  misc_feature (1887)..(1887): n is a, c, g, or t
  misc_feature (1898)..(1898): n is a, c, g, or t
  misc_feature (1905)..(1905): n is a, c, g, or t
ggagtccagtgctggaggggcaggacggcggcggcgcagctcggaacccgccaggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcatgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctaaccaatcccaaaatcagaccagattggcctgccagaacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatcnantnnccaccaccgtgcgggacatcatgaaccgtggancctgcagatgngcttccnggtatcacggtgggataccagcacgggggaaccctttacccaggaaagaatttcctcctttgaacccggatcccaatggtacccggccctcaaattcagtacgtgtggattgtgcccattaaatccattcgagatggcagacagacagcgggactctggggtggtaagtgggaaaagccaaacggaccttcaggcatcaggcagagtggggcctagcggaaccacaatgtgatgaggcaatcccggggagccaacacaagaaactgttataacacacactggccggagcaagaacactgcgcaccacgatgtataggggagacaaaaatagaactaacaacggagccagacgacagtactgcaggtgcacaccaccacttgtaggtaagacacgcagcagcagcgacagagactagctgcacacgtgcacagccaaacagcatcgtactgcatcgcagcggtcgcgcgctacgatcgtatcttgcagagctgagtgacgagcgaagcaagaccgcacgagcggagc

SEQ ID NO: 327999 - DNA, 407 bp, Homo sapiens
gacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaagtgagttccggctgggctgcccggtggggtggatccgaggtgctgaggcaaggctggattctgagggccaaggaaggacttagcttgcaggcctttgaaccctgtggagcccgagactggcccattgcttcacctccagctgctggcaaagcagctgcaaatgcaccgaactgggagggcttccccacccctcaccagggagctggggatgagggacagagcgtcccttggacagac

SEQ ID NO: 328000 - DNA, 1919 bp, Homo sapiens
ggagtccagtgctggaggggcaggacggcggcggcgcagctcggaacccgccaggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctaaccaatcccaaaatcagaccagattggcctgccagaacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgggaggccagcaccacctgggagccagtcaccacctgggagcca

SEQ ID NO: 328001 - DNA, 2055 bp, Homo sapiens
  misc_feature (1473)..(1473): n is a, c, g, or t
  misc_feature (1475)..(1475): n is a, c, g, or t
  misc_feature (1477)..(1478): n is a, c, g, or t
  misc_feature (1511)..(1511): n is a, c, g, or t
  misc_feature (1522)..(1522): n is a, c, g, or t
  misc_feature (1529)..(1529): n is a, c, g, or t
ggagtccagtgctggaggggcaggacggcggcggcgcagctcggaacccgccaggtccagggtccaggttccagcgcccggcggcccagatctcgctcctcggtctaaagcctccgccgcagctctcagtgaagaggaaggggaactctaggtgctcaacgcccgcgttacagtcgcgttctccctcgctcctacaacccggccaagatgccggggcatggatggggaccgaggtttgggggttgtggagcctattccacgccctccctggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccagtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctaaccaatcccaaaatcagaccagattggcctgccagaacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatcnantnnccaccaccgtgcgggacatcatgaaccgtggancctgcagatgngcttccnggtatcacggtgggataccagcacgggggaaccctttacccaggaaagaatttcctcctttgaacccggatcccaatggtacccggccctcaaattcagtacgtgtggattgtgcccattaaatccattcgagatggcagacagacagcgggactctggggtggtaagtgggaaaagccaaacggaccttcaggcatcaggcagagtggggcctagcggaaccacaatgtgatgaggcaatcccggggagccaacacaagaaactgttataacacacactggccggagcaagaacactgcgcaccacgatgtataggggagacaaaaatagaactaacaacggagccagacgacagtactgcaggtgcacaccaccacttgtaggtaagacacgcagcagcagcgacagagactagctgcacacgtgcacagccaaacagcatcgtactgcatcgcagcggtcgcgcgctacgatcgtatcttgcagagctgagtgacgagcgaagcaagaccgcacgagcggagc

SEQ ID NO: 328002 - DNA, 904 bp, Homo sapiens
cagtttaaatcctttccaaaatttatgtagctagtgcatatttttatctaataccaattcttaaaaagaaagaagcactataaagactaaaaagtaataatttataattaactcatcaacttgtatgagaaaattttttcccaaaggatttgcaacaatatatattcactcaggaggtaaaaacagtagcctccctacatatttttggacattactaatttgttttctttccataagtagcaaagtaataaacttatacctagccctttttctgaattaaatatttaagtaatggtggtctaagcaatgaggttgagctctgcacaccacaaatattgcaggattgatcgattatcttgttcagtttttgccttcctaaaatttaacagcaggctgcaactttttgtgagatattaattataacatatctctgactgctttgacctgatgaataaaataccatcattttgttttctccttaaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccaggtacgtggctttcattggccgtattcagtgtctattggtacctacttatatttctgtatatagggtggcatgcacatccacctgactcccactgcacctgtgccacttacaaaatataaatgctattttcatctcttataccaagcacattttctatttcttgcctgagtcaagg

SEQ ID NO: 328003 - DNA, 255 bp, Homo sapiens
tcctggaccctatagaagtttagaaaagcaaagtctattataaagtgatgtttaggctgggtgcagtggctcatgcctgtaatcccagcacgctgggaggctgagttgggcagatcacatgagctcgtgagttcaagaccagcatgatgaaacccatctctactaaaaatacaaaaattagctggaaatcgcttgaacctgggaggtggaggttccagtgagccgagatcgccggcactgcactcctacctgagc

SEQ ID NO: 328004 - DNA, 6176 bp, Homo sapiens
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggcccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctgactgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagtaaaaaaaaaaaacaggagcagcaccagacacaactaacgacacagcaacggacaccacacacacgatacccagaagaacagaaaaaggaggagcaccgtcaacaaaacaccgtgagaagaaaccgaaacgccccaacaatgaagaaagaagaggccccacgagacagagaaaaaaagacgacgcggacacacacagaacgtaggaggcagagcaaaccaaggaagtaggaggaccacgttgtggtgataatagacgaaacccatagactcacgaacgaaaacatctgataaggataccaaccgccgcgaacgctcaataaaaacgcatgagaagacagagaacaagaaaaagaaggagacaaacgaacgagatacaacg

SEQ ID NO: 328005 - DNA, 3889 bp, Homo sapiens
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggcccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctgactgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataac

SEQ ID NO: 328006 - DNA, 6575 bp, Homo sapiens
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattgtgagttttagccttaataactttttctttgatattctaagcagaattgaaatttttattaagttttattgaatatttgatctcatgcttaagagataattgtaacttcagcatttgacactggcacaatggaagaaggttatttcttttattcaccaaaataggagcagaacagaagttgccattatgagaaaccaaaagacaaaatacattaggagaagttctaatttaattccataatttgtatatcacttattaaaatttattataatttttaaacaataacaaacctgcatctaatacttattacattgggggaattaccgaaacaattcatattctgcaaaatcttgaaataagaaaaatatattgtttctaaaagttttccaaatttaatacatagtttttgtagggtttagataagtggaaaatattcaacaaatagctagtattgcaactggtttacggtttatgtcagtataaagccacaaatacacaagaaaagtgtatttttaacatccttgattttgtacttgcatttttgtcttggtaaattaaatagttcatcctttagggaaaaagtttttaggtgtgttggtttgcagtaattgtgaaacatggcagccttccctgttaacactggccattggccccaggagagcagcaaccaggatgtataattagcccttctttttacaggttggcaacctgtaattacagaaaacttttggtttgtttgctaattccttttttttttttttttaatatacattctagctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggcccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctgactgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagta

SEQ ID NO: 328007 - DNA, 3812 bp, Homo sapiens
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattgtgagttttagccttaataactttttctttgatattctaagcagaattgaaatttttattaagttttattgaatatttgatctcatgcttaagagataattgtaacttcagcatttgacactggcacaatggaagaaggttatttcttttattcaccaaaataggagcagaacagaagttgccattatgagaaaccaaaagacaaaatacattaggagaagttctaatttaattccataatttgtatatcacttattaaaatttattataatttttaaacaataacaaacctgcatctaatacttattacattgggggaattaccgaaacaattcatattctgcaaaatcttgaaataagaaaaatatattgtttctaaaagttttccaaatttaatacatagtttttgtagggtttagataagtggaaaatattcaacaaatagctagtattgcaactggtttacggtttatgtcagtataaagccacaaatacacaagaaaagtgtatttttaacatccttgattttgtacttgcatttttgtcttggtaaattaaatagttcatcctttagggaaaaagtttttaggtgtgttggtttgcagtaattgtgaaacatggcagccttccctgttaacactggccattggccccaggagagcagcaaccaggatgtataattagcccttctttttacaggttggcaacctgtaattacagaaaacttttggtttgtttgctaattccttttttttttttttttaatatacattctagctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggcccaatgacgtgaacatgatcaaaagtgagtcatgcacccacggccagtgaggcccaacgtgcctagagaggagaaatggctggaatgtgtagggggtggattttctttttttagattttacagcttaggttttcatagagcagatgtttcataaagtcacttaaccatgacaacgcctgtgaccctacccccagaaagcccacagcccatcaggaggaaagagtatcactgacagggcttctgaaggatgcgaagaggaaaataaggtctatggggggaaatttatccttatatttttattcttttatatagatgttgtgtatttttttctctcttactggttctcttccc

SEQ ID NO: 328008 - DNA, 5798 bp, Homo sapiens
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggcccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctgactgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagta

SEQ ID NO: 328009 - DNA, 3265 bp, Homo sapiens
cagtttaaatcctttccaaaatttatgtagctagtgcatatttttatctaataccaattcttaaaaagaaagaagcactataaagactaaaaagtaataatttataattaactcatcaacttgtatgagaaaattttttcccaaaggatttgcaacaatatatattcactcaggaggtaaaaacagtagcctccctacatatttttggacattactaatttgttttctttccataagtagcaaagtaataaacttatacctagccctttttctgaattaaatatttaagtaatggtggtctaagcaatgaggttgagctctgcacaccacaaatattgcaggattgatcgattatcttgttcagtttttgccttcctaaaatttaacagcaggctgcaactttttgtgagatattaattataacatatctctgactgctttgacctgatgaataaaataccatcattttgttttctccttaaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctgactgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagta

SEQ ID NO: 328010 - DNA, 3264 bp, Homo sapiens
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattgtgagttttagccttaataactttttctttgatattctaagcagaattgaaatttttattaagttttattgaatatttgatctcatgcttaagagataattgtaacttcagcatttgacactggcacaatggaagaaggttatttcttttattcaccaaaataggagcagaacagaagttgccattatgagaaaccaaaagacaaaatacattaggagaagttctaatttaattccataatttgtatatcacttattaaaatttattataatttttaaacaataacaaacctgcatctaatacttattacattgggggaattaccgaaacaattcatattctgcaaaatcttgaaataagaaaaatatattgtttctaaaagttttccaaatttaatacatagtttttgtagggtttagataagtggaaaatattcaacaaatagctagtattgcaactggtttacggtttatgtcagtataaagccacaaatacacaagaaaagtgtatttttaacatccttgattttgtacttgcatttttgtcttggtaaattaaatagttcatcctttagggaaaaagtttttaggtgtgttggtttgcagtaattgtgaaacatggcagccttccctgttaacactggccattggccccaggagagcagcaaccaggatgtataattagcccttctttttacaggttggcaacctgtaattacagaaaacttttggtttgtttgctaattccttttttttttttttttaatatacattctagctcctgggagctacagctattgaagacaagctacaggatggagttccagaaaccatttcaaaacttgcaaaagctgacattaagatctgggtgcttactggagacaaaaagggtaattcattgtgcagggaagcatatctgttaattcacaaatatttatagctgccgtttcctttgcccaagatgacctcctcagacttttcatcctgtacaaacactgtttctttggacggaagatgctttttctgagaaaccctcctctgtttttccagcacattcttctgcatcctttcctgatccccctcagtagcagtttcttccttataatttagctcctggccatgtcttgctgattataattggtcttatctctccagccagacgtgggtt

SEQ ID NO: 328011 - DNA, 569 bp, Homo sapiens
gggggcggacacccgggtgacacattctttcggagagggagggcaagacttttctccggagcctctggcaactcgtggagtctatataagggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttggc

SEQ ID NO: 328012 - DNA, 3233 bp, Homo sapiens
cggggcggcccgaagatggcggcggtggctggatctggggctgccgcggctccgagctcactgctcctcgtggtgggcagcgagttcgggagcccggggctcctcacctacgtcctggaggagctcgaaagagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgccccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttggc

SEQ ID NO: 328013 - DNA, 1651 bp, Homo sapiens
  misc_feature (1610)..(1610): n is a, c, g, or t
  misc_feature (1614)..(1614): n is a, c, g, or t
  misc_feature (1645)..(1645): n is a, c, g, or t
cggggcggcccgaagatggcggcggtggctggatctggggctgccgcggctccgagctcactgctcctcgtggtgggcagcgagttcgggagcccggggctcctcacctacgtcctggaggagctcgaaagaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgccccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccggagtaagaaaccaacatgtccgacacgngagncggactttggcactaaaaatcaggacagccnaggcag

SEQ ID NO: 328014 - DNA, 326 bp, Homo sapiens
cacctgccaggttcacctgcagccacttggctcagtgggactggcgggcgtgatgcgcccgtgggtggagatgggtgttcatcccccatccctcggagcatctggacctggcgtttcattgcatgtaaaatgggacaggaacacgcacctcggttcatgtgcttgaggagtgtttagtgagcacctgctatgcgccaggcctttgggcagtggacacagggatatggccgggatgatagacaggttcagccctgccaacacaggtctggtttggggatggacccaaagcgagtgaggagatggaacaagcttccagctcacatggt

SEQ ID NO: 328015 - DNA, 3283 bp, Homo sapiens
cggggcggcccgaagatggcggcggtggctggatctggggctgccgcggctccgagctcactgctcctcgtggtgggcagcgagttcgggagcccggggctcctcacctacgtcctggaggagctcgaaagaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgccccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttggc

SEQ ID NO: 328016 - DNA, 3298 bp, Homo sapiens
ggctcagtgggactggcgggcgtgatgcgcccgtgggtggagatgggtgttcatcccccatccctcggagcatctggacctggcgtttcattgcatgtaaaatgggacaggaacacgcacctcggttcatgtgcttgaggagtgtttagcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgccccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttggc

SEQ ID NO: 328017 - DNA, 454 bp, Homo sapiens
tctttgggtgctggttgggaggaacagggacctcacagacgggctgaccacccattgcagacctcaaggtggagcacacaagatcagggaaaagccaggaggggtctcaaatgccaggaaaggaaggcgacttgggcccaggccagaagggcagggggcacccccctcactggtggtccactctccccacacaccccccctccacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttggc

SEQ ID NO: 328018 - DNA, 436 bp, Homo sapiens
tgcccctgcccctcaggctctactgtcctatctgtcccatctgtcccccacccacacacttctcccaagctactccaggcaggcatggtcttctctcttaatttcctatctcaccccatagtttttccaccatcttcaaaactcttccctgatctcagcaaaccaagactctcctaattgtctctggcgcccaaaatctgcatgtaccaccctcctacgctcactcctcagtgttttccccaagttactctttccacgctgaccctctccacgcttcactcctcccagcctactccctcggcgtccaccccccgttaccggccccttcttactctcctgggcccttcttccccgccatccgtcggtcaggccttctctaggtcaccgcttgcctccccgggccaaccgccgccgcccagtgttagctgctgagcct

SEQ ID NO: 328019 - DNA, 446 bp, Homo sapiens
tcgggttaaaaaagagtccagacaatgtgatttaaaatgaaaataatttaagcttatttgtggtgagagttaaaaataaagttggctccaggtatcatttgtggaactgatttgttttagcataattgtttttgaactagctcgtttttaacttgtatttttaaagttacacttttaaaatgtaggagtctgttttgtaaacttgtacagcccctgctaacttttagaagagtagagtggcttatttcttcatgtgtgtttattctgggctgtcatctgatgaagttaccagtttgtggtcagaaattgagaaagaggagtgaggaaacgaaaaatattgacacgtacacatcaccttgcagtgcatgagagtgcccttttggactggttaggaaactaacatttgagcatatttgctcagcagaaactttttatgtgtgaaagtt

SEQ ID NO: 328020 - DNA, 470 bp, Homo sapiens
aacccctcttgtttttctctccacacgtgaaagtcaggaagaaaaccatctgcttagtgtctgaacctaacttcagttcttactttcaaaatcaccttagccaaaccatacccccagggcaaatactctccagccccaactcatctctccttcttaggcacatgggctgacacaccagctccttagcatggccattcctctttttacattttctcattatttcaacccatgcatcctagaatctcatatggcttctcccttctgaacttcaacttgtcctctaagaaaataaacagtccagaatcccaaactgtcagacctgaaaaagacgtcagagatcactcgattcgaaccttgcaacatacagctggggaaactgaggtccaaagaaaggtaggcactggcccagagccacacagctgctaggcagtgtgggaggaggggctaaaaacctggcttttgaggctggg

SEQ ID NO: 328021 - DNA, 420 bp, Homo sapiens
tcagttcttactttcaaaatcaccttagccaaaccatacccccagggcaaatactctccagccccaactcatctctccttcttaggcacatgggctgacacaccagctccttagcatggccattcctctttttacattttctcattatttcaacccatgcatcctagaatctcatatggcttctcccttctgaacttcaacttgtcctctaagaaaataaacagtccagaatcccaaactgtcagacctgaaaaagacgtcagagatcactcgattcgaaccttgcaacatacagctggggaaactgaggtccaaagaaaggtaggcactggcccagagccacacagctgctaggcagtgtgggaggaggggctaaaaacctggcttttgaggctgggcgcggtggctcacacttgtaat

SEQ ID NO: 328022 - DNA, 2689 bp, Homo sapiens
ctcctccaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagagcgtcagaagccatgatgcatgtagtgtgtgtgtactgcagctggagtgggccccagaccagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggctagaccgttctccattccctttaaacaaaagaaagctctctctatatacacgcacacatacacactcaccacatatacagtatatatagaaacctgcaagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgta

SEQ ID NO: 328023 - DNA, 2885 bp, Homo sapiens
ctcctccaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagattgctgtgtgtattgtgagagaatggaagcaaccaacaaatattttggatgtccaaactacagaaacatccctcaacttggaatctaccagttcctgattttaaagatggcaaaagaacggaaactataaccctgcatgctgtgtggtttgcattgttaacccaagtttgcttgtctgtttcctaattcacacagagcgtcagaagccatgatgcatgtagtgtgtgtgtactgcagctggagtgggccccagaccagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggctagaccgttctccattccctttaaacaaaagaaagctctctctatatacacgcacacatacacactcaccacatatacagtatatatagaaacctgcaagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgta

SEQ ID NO: 328024 - DNA, 997 bp, Homo sapiens
ctcctccaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagattgctgtgtgtattgtgagagaatggaagcaaccaacaaatattttggatgtccaaactacagaaacatccctcaacttggaatctaccagttcctgattttaaagatggcaaaagaacggaaactataaccctgcatgctgtgtggtttgcattgttaacccaagtttgcttgtctgtttcctaattcacacagagcgtcagaagccatgatgcatgtagtgtgtgtgtactgcagctggagtgggccccagaccaggtatttatagacaccatgttaagccttccatccagttgtcatctgtgatctgacagtctgtatccgcagcagtttgggaagttagcatttgtcattcaccatttcaccttgttcaatctggttacaactagcctatatgcatttgtattttggcatgcatacatggatatgtaacataaactcctgtttaaaaatggattcgttattagaaccatccaacagggagaaaatcccagttaaaacagtgtctattatatctaccccatcttggctactataaatatcacatcaagaatattggcctca

SEQ ID NO: 328025 - DNA, 692 bp, Homo sapiens
gaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggctagaccgttctccattccctttaaacaaaagaaagctctctctatatacacgcacacatacacactcaccacatatacagtatatatagaaacctgcaagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgtagcatactgttttagaatgagagtaaatgctttgaaaagcagaagccatgagaaatcccactacccatccagctaaaaacagatgaactctccacactgtgactgtgtgtctgtgctgatggcaaggtatggtttgctggctcagttgtcaatttagaaacttttgaccacataatttggtgtttggaattctacccagtgctctgtgtatacatgattcattaattataacaggaaattggagaataattgaatatcttat

SEQ ID NO: 328026 - DNA, 2925 bp, Homo sapiens
ctcctccaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagagcgtcagaagccatgatgcatgtagtgtgtgtgtactgcagctggagtgggccccagaccagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggctagaccgttctccattccctttaaacaaaagaaagctctctctatatacacgcacacatacacactcaccacatatacagtatatatagaaacctgcaagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgtagcatactgttttagaatgagagtaaatgctttgaaaagcagaagccatgagaaatcccactacccatccagctaaaaacagatgaactctccacactgtgactgtgtgtctgtgctgatggcaaggtatggtttgctggctcagttgtcaatttagaaacttttgaccacataatttggtgtttggaattctacccagtgctctgtgtatacatgacctgggacctctagacaccc

SEQ ID NO: 328027 - DNA, 508 bp, Homo sapiens
ctcctccaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcaggtatttgggatggccaaactcttcaatacttgttattgatgggtaagcccgggaagtgtgggcttcagaaggggta

SEQ ID NO: 328028 - DNA, 237 bp, Homo sapiens
gctctctagctacgcctgcctcagcagccagatgagaggttacgcacatgaagagcatgcctgccgtgggtcattgtcactcagcaattaggcatcagacacccgaatctccctttcttgctccattttcctctgcacctgagtagaaacatgcttcccctgcaaaatgtctccagggtggtgtgtcccaattatgatccagacatttccgagcgccctggattcttgagccaccag

SEQ ID NO: 328029 - DNA, 238 bp, Homo sapiens
agaagaagaggtgggcagcaagcatcctagctcaggaccttaaagccaggctgaaaaactctttgcaaagtgagatatggtaaatattttcagtttgatgggctaccacagtgggaaagtagccaaaggtaatatgaacgggtgtggctgtgttccaataaaactttatttacaaaaataagctgtgggtgagtgggtgagatgtggcccacaggcagtggttggccaacccctgcct

SEQ ID NO: 328030 - DNA, 259 bp, Homo sapiens
aaagaaagaaggaaagaaggaaggaaaggaagaaagaaaggagggagggagggggaaggagagagaggaaggaagagaaagaaagagaaaaagaaaaggaaagaaaaaagagaaagaaagaaagaaggaaagaaaagaaaagaagaaaattcttttatatattgaagttggcaacttctctggtgccttcctctctttctctttctttcttttctcttcccctctctccttcctcccttcttcctctttctctttcttt

SEQ ID NO: 328031 - DNA, 326 bp, Homo sapiens
agcatttgctgtgtgcatcattattttactgcatgcatggccaggagggtgtggtaatgtcttgattgatcacaagccactgcagaggtcctcaatcaggacagatggatggatggatacatggatgcatggaagaatgcacagacagaatccccagtgtgacacaggctcaccaatggctgactggttgaataggtatgaatgaatacacgaaccaattctagtaaggtcaattgttccatttcttagtccctaactggtagaagcatgaaattgggaaggacacacacacacacacacacacacacacacacacacacacacac

SEQ ID NO: 328032 - DNA, 501 bp, Homo sapiens
tgggcgaactcacttgaggtcagggagtgcgagaccagcctggccaagcagggtgaaaccccgtctctcctaaaaatacaaaaattagttgagtgtagtggcacacgcctgtaatcccagctactcgggaggctgagctaggaggattgcttgagcctgggagtttgaggttgtagtgagctatgatcatgccactggactctagccaggagcctgggcaacagagcaagaccttgtctctaaacaaggcaaaacaaaaacaaaaaaacaaaaatcaattgcatttttatatattagcagtgaacacatggaaatacatgcaataccatttataacagttcaatcaaaagaaatacttgagcatatatctaacaaaacgtatataggacttacttgtatactgaaactgcaaaatgctaatgttagaaatacggaccaaaatagtgagagatactgtgttcatgattggaagactcaacatagtaaagatgtcagttctcc

SEQ ID NO: 328033 - DNA, 1318 bp, Homo sapiens
tttttttttttagacggagtctcgctctttccccccagactggagtgcagtggcgcaatctctgctcactgcaagctccgcctcctggcttcacaccattctcctgcctcagcctcctgagtagctgagactacaggcgcccaccactgcacccagctattttttctatatttttatgtagttcattgagggtaataattttatcctacaacaaacatgtaagttattgaagaatattggagttttatgataatgctgtcataaatataaaaggtagggtaagagggatccaaatagagctcacttatattgtcactgataggcagtcacgctgtgctgatagaatgtggcctgacacttgatggagtgcagcatatgtatacttgggcaatttgagcagatatatacggtcccgagtttaaagaagagaacaaacaccagtgcacagctatagtattcctaatataggatgcattttaaagaatttcacattctacaaatggagagagatggcaggagaagccttattttaagtcctgcactaaggcaggttaacctcatgggtgtaattacctggacctttttgtaaggacaaaatatttaatcattaaaaggccctctgtagggtttgaaatatctatattttatatatgaatgcttcttttattaatatttatggtaagatattttatactgctgataaacggacattaatgatatatagcctattgtttgaaaaaagcattttggattatagcccaaaactggaaataaccaacagataaataaatggtggtatattcatacaataaaatactactcagataaaaaagatgaacttaatctcataaacattatgggcaacatagtgagaacccatctcttttaaaaaaaaaaaaagaaaagctgggtgtggtgatgcgtgtcatagtcccagctactcgggaggctgagctaggaggattgcttgagcctgggagtttgaggttgtagtgagctatgatcatgccactggactctagccaggagcctgggcaacagagcaagaccttgtctctaaacaaggcaaaacaaaaacaaaaaaacaaaaatcaattgcatttttatatattagcagtgaacacatggaaatacatgcaataccatttataacagttcaatcaaaagaaatacttgagcatatatctaacaaaacgtatataggacttacttgtatactgaaactgcaaaatgctaatgttagaaatacggaccaaaatagtgagagatactgtgttcatgattggaagactcaacatagtaaagatgtcagttctcc

SEQ ID NO: 328034 - DNA, 856 bp, Homo sapiens
  misc_feature (5)..(6): n is a, c, g, or t
  misc_feature (9)..(10): n is a, c, g, or t
  misc_feature (12)..(13): n is a, c, g, or t
  misc_feature (16)..(18): n is a, c, g, or t
ggcannatnngnnacnnnttttttttaaatatatacttgattttacagactttctgcagaaaacctattgggaatttttgtaaagagaaaagttgggttgtggtaaaaatgcataaacacatatctcctaatatctaaatttgtaaatatatatctacaatattattttaaatctgttttgttttccaagacccaccaatgacatgagatacccaatgaagtcagaaaaaatacatggcttaggatggagacctaaagtgccttggaaagaaggaataaagaaaacaagtatgttttgaattaatcattttgggggcaagtcagaaaaatttaaaggaaaaataacttatttccagaacattatacaaaccagtggaatattgtgttgaatcattcgtacttttcaaattgccacatttcatatatttctagtagcagtcctgtgtttcctaagcatcttgaattttataaaccaacctctgatcaatcttcccatatcttgttagcattaatcaaatacctgtattatttattctgaggtacatattttttcactttcttcacactcctaaaaggtatgtatttttataatcactggtgtcttataattattattgtagcttttttcttttttacatgtatgtaaaataatgatccatcagtggcatcttagagttggtgaaatatagatgcagtcttttttgtgtcttgaggctttttatattgaaaccaacagaggaaataaatttagtatgtgcagaaaaatctattaaaataagtgcatataaagtctgtgtatacatgttaaagctgtatttagaaatgtattcatgagaaaagctctacccagatgtag

SEQ ID NO: 328035 - DNA, 1278 bp, Homo sapiens
gttgatgtcacactagaatgcagttggacaggctgactgggagcaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 328036 - DNA, 1915 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaatttatcatgtttactgtttaaaatgattgtatttataaaattgtcaatatcttaatgtatttaatgtagaatattgctttttaaaataatgtttttattttgctgtagaaaaataaaaaaaaatttgattatatatttttaatcgttctttgccctaaagacttt

SEQ ID NO: 328037 - DNA, 1988 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcatgtaggtaatggcgccgctagccaagcagtggctccccagaaacccctaccttttcccgcagctctgcttgccctagtgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 328038 - DNA, 1821 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 328039 - DNA, 1949 bp, Homo sapiens
cgtcacagtgtggccgagacaggaaggagcaaatatgcttctttgcgggaaggatctggaaagatgcggccgaccagtcttttgcacattggcttccaaggggagggttggggaaatggaaaccagctttcaggtgcggaacacgatcactagtggcgagaggccgctgcctggggctggaaagccgcaccagcggggttggcaaggaacgcatcccaccattcgcggcagctgctgcaacgctggaggtccagtgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 328040 - DNA, 1768 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaagtatgttttgaattaatcattttgggggcaagtcagaaaaatttaaaggaaaaataacttatttccagaacattatacaaaccagtggaatattgtgttgaatcattcgtacttttcaaattgccacatttcatatatttctagtagcagtcctgtgtttcctaagcatcttgaattttataaaccaacctctgatcaatcttcccatatcttgttagcattaatcaaatacctgtattatttattctgaggtacatattttttcactttcttcacactcctaaaaggtatgtatttttataatcactggtgtcttataattattattgtagcttttttcttttttacatgtatgtaaaataatgatccatcagtggcatcttagagttggtgaaatatagatgcagtcttttttgtgtcttgaggctttttatattgaaaccaacagaggaaataaatttagtatgtgcagaaaaatctattaaaataagtgcatataaagtctgtgtatacatgttaaagctgtatttagaaatgtattcatgaggcttttacccacttgcatgactaccaagttcgatttagacgtctgaattcctctccttaagtcaattattatccatcatctctcttttacctttcgcttctctctcct

SEQ ID NO: 328041 - DNA, 148 bp, Homo sapiens
gttatcttagaaaaaattaaagttatctttgagtattttcctagtactcaacaccttaggaaaatattcaagagtttagggaagttaaagtttttcactaacaagatatactttttttccatagtgcatcacatatgattgtctcttt

SEQ ID NO: 328042 - DNA, 1912 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 328043 - DNA, 859 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttttccaaaatttatatctttgttcagcacatcaggaaatgttcgattactgggtagggcttaaacaagaacttctttttactactgatgtgaagaccattttcattgccta

SEQ ID NO: 328044 - DNA, 1681 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaagtatgttttgaattaatcattttgggggcaagtcagaaaaatttaaaggaaaaataacttatttccagaacattatacaaaccagtggaatattgtgttgaatcattcgtacttttcaaattgccacatttcatatatttctagtagcagtcctgtgtttcctaagcatcttgaattttataaaccaacctctgatcaatcttcccatatcttgttagcattaatcaaatacctgtattatttattctgaggtacatattttttcactttcttcacactcctaaaaggtatgtatttttataatcactggtgtcttataattattattgtagcttttttcttttttacatgtatgtaaaataatgatccatcagtggcatcttagagttggtgaaatatagatgcagtcttttttgtgtcttgaggctttttatattgaaaccaacagaggaaataaatttagtatgtgcagaaaaatctattaaaataagtgcatataaagtctgtgtatacatgttaaagctgtatttagaaatgtattcatgagaaaagctctacccagatgtag

SEQ ID NO: 328045 - DNA, 1897 bp, Homo sapiens
tccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcatgtaggtaatggcgccgctagccaagcagtggctccccagaaacccctaccttttcccgcagctctgcttgccctagtgcatcacatatgattgtctctttagtggaagattatccaaactatatgatcataaatctagacaagctggattactgtgcaagcttgaagaatcttgaaaccatttctaacaaacagaactacaaatttatacagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 328046 - DNA, 2516 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaaaaaaaaaaaaaaaaaaaaaaaaaaaaaaaaaaaacaaaaaaaaaaaaaaaaaaaaaaacagaaaaaaaaaaaaaaaaaagagggggaacgcgcctaagaaacatttaacgactgggggagcgcacaggaccgaacacgcccgccaacttatatgatctcgaggcaacgcacaaagaggtgggactattttaaaggcagaagagcgagatgcactaacaccgaggcgtgagcgagacacaacaactagatagtaccgaatgtggaaggaaacgaaacacccacaaagcagtggaggagcagcacaatagtagtggacgacaatacaccagaaaaaggagagcacacgcgaaaggagaaagacataacaacgagaggcgaaagctgagagcaagaacaaaaaccaagtagaacgaggggagccaacgagacaaacacaacctagacaagaaacctgtacgagggaggaggagacacaagacccacagagaagaa

SEQ ID NO: 328047 - DNA, 1867 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtt

SEQ ID NO: 328048 - DNA, 722 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtactt

SEQ ID NO: 328049 - DNA, 705 bp, Homo sapiens
  misc_feature (19)..(19): n is a, c, g, or t
  misc_feature (28)..(28): n is a, c, g, or t
cgaagtacggatatgtcgnccagcgtcnggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtactt

SEQ ID NO: 328050 - DNA, 726 bp, Homo sapiens
  misc_feature (27)..(27): n is a, c, g, or t
cctcggatgtttaatcgataagcttgnttggggagggcgggtcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacgaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaacca

SEQ ID NO: 328051 - DNA, 439 bp, Homo sapiens
  misc_feature (20)..(20): n is a, c, g, or t
tttgttttcaaaaaaaaaanacagcggcgccgcgaatttagtagtagtagtagtcgactactactactactactactactaaattcgcggccgcgcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtactt

SEQ ID NO: 328052 - DNA, 2739 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttacagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaa

SEQ ID NO: 328053 - DNA, 2023 bp, Homo sapiens
  misc_feature (27)..(27): n is a, c, g, or t
cctcggatgtttaatcgataagcttgnttggggagggcgggtcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328054 - DNA, 2083 bp, Homo sapiens
gccagttagagctgagggagggctcaaaagcagtagaaaggatgacttgcgcgggtaggttaggaaaataggaccgtccccctctaacagaatataaccaacgtccccctacctggggatagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328055 - DNA, 1975 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatctgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328056 - DNA, 2128 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaattcgggcgtacatgtgcaggtttgttacgtggatgtattacatatactgaggtttgggcttcaactgaacccgtcacccaaatagtgaacatagtacccaatagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328057 - DNA, 823 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttcttgtagtactccgattgactctcattgagaacaatcctaaccttccattcgggtcccatgcgggccaccagaatccatggcagccaactcgcggcccccc

SEQ ID NO: 328058 - DNA, 1034 bp, Homo sapiens
gaaattatcctcaagatatgaaagaaaactatttcaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataacctctgcacttcagcctgggcaataaagcaagacccagtctctagaaaaaaaaaatgattaggtaaagaaaagaaaacaaattttcacaatgggagaatgtggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328059 - DNA, 473 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttcaagatagttctctttgattcccccaggaacctccgcatcatctgtcttttggaggattcagattcttacgacatctgtgataccgtccatgaggataccaacggtgcttagtagtaaagtgtgcctcatttgccatttgagaaaatgcagtctggtgtattcagtaatatatagtaaagtaataatgataaaatatcttttcatatattagaatgtgtactt

SEQ ID NO: 328060 - DNA, 2023 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328061 - DNA, 1154 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcct

SEQ ID NO: 328062 - DNA, 754 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctc

SEQ ID NO: 328063 - DNA, 1326 bp, Homo sapiens
cggtagatagtggatgggaggggggtcggtgagaagcgtcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaa

SEQ ID NO: 328064 - DNA, 2537 bp, Homo sapiens
gcgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaaaaaaaaaaaaaaaaaaaaaaaaaaaaaaaaaaaaaaaaaaaaaaaaaaaaaaaaacaaaaaaaaaaaaaaaaaaaaaaacagaaaaaaaaaaaaaaaaaagagggggaacgcgcctaagaaacatttaacgactgggggagcgcacaggaccgaacacgcccgccaacttatatgatctcgaggcaacgcacaaagaggtgggactattttaaaggcagaagagcgagatgcactaacaccgaggcgtgagcgagacacaacaactagatagtaccgaatgtggaaggaaacgaaacacccacaaagcagtggaggagcagcacaatagtagtggacgacaatacaccagaaaaaggagagcacacgcgaaaggagaaagacataacaacgagaggcgaaagctgagagcaagaacaaaaaccaagtagaacgaggggagccaacgagacaaacacaacctagacaagaaacctgtacgagggaggaggagacacaagacccacagagaagaa

SEQ ID NO: 328065 - DNA, 2006 bp, Homo sapiens
  misc_feature (19)..(19): n is a, c, g, or t
  misc_feature (28)..(28): n is a, c, g, or t
cgaagtacggatatgtcgnccagcgtcnggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328066 - DNA, 2003 bp, Homo sapiens
cggtagatagtggatgggaggggggtcggtgagaagcgtcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattta

SEQ ID NO: 328067 - DNA, 419 bp, Homo sapiens
aattaataatctacggtaatgtactatagagcttttttctattcttggaagtgttaaggataactcataatctaaatcagatttctcatgatgattctatgtgtccaggtatgtaattgagctcactgtgtatccaaatccagctgttaatgagttctgtgctaagggaatattaaatttaagaaagtttttttgggttcttaagagtaatttcttcaacttggaggagtatttgtgctttctatccttgagaccagatagaactcatcgattctagagagaagtagagtttcagtctcattctgctgtacactggctgtgtgaccttgagcacattaaacctctattaacctgtttcctcttagaattttgagaataaaatgatgtaatccacagtgcctgaaacatggtatgctcaa

SEQ ID NO: 328068 - DNA, 464 bp, Homo sapiens
gatcacaggcatgctctctagaacagtgtatctgactgagtaggttagcatattatcatcctgagaaagcagtggcctgattctgtaacaaatactttaactgcttatgtttttattttcaactttgactatttatgaacactgcagtgttcttatgaataattgtcttggcacttgtagtcctaaactgggcacttagaacaataaaaaatcctacagatcatttaaacaagtgaaaccctaatatataagtgagcgtatgattacattttcacttgttttcatactttgcaaatttgaaagtaactcatgttggaaaaactgttctttagctttcccagttagtatctgtagataatataagtattatctatagatatcccagtgatatgtactgatatggtacttaaaacaatctgcatttgaaaacttagtccatatattaaattacccttacagataaa

SEQ ID NO: 328069 - DNA, 821 bp, Homo sapiens
tctttaacactgtactgtatataaaacagaagctcaataggtgtttgttcattgaataaaaggaagaattctctcagctttttcccacagtaagcaacagtcacatttcagagtagagcaacagcccctaagagcttcttttcagtattttgtcagcttgttagccctgctgaaaactgtcacaggctgcaggcagcaacagagatgacagacttcttgcatggagctgaatccacaccctcagcacaatccctgagggagctaaacgggaggaaaaatgggtaagagctgggcactcctccccacttaagtctgagtggtgagattattaatcattttaaagtcagatctttatgcttttctatgtgttctacaagttaacatgtgttattttataaatggaaaggttgttaattaggagggaaatatgaaataaggcatccattgccctcttcattaataaacaacaaaattaaatgtgcttattttttaaaaaatcctgtgttttacttttgtgtcagaaccacaactggacttattctaatttgttttaacaagcaataactgattccctgcataattatttcaagaaatgagtttttaaacacatttaaaatgtttttacttatttcactagttttgggggaacaggtgttttttgattacatggataagttctttagtggtgatttctgagattctgatgcacccatcacctgagcagggtcactgagttatccttcaccttcctcccacctttccccgccagtctccaagtccattatatcattcttatgcctttgcatcttcatagcttagct

SEQ ID NO: 328070 - DNA, 282 bp, Homo sapiens
attcttactgagtgccactatgtgtgtgcacagtctgtgcgtagccgtggggatacaatgacgaataagacaagcccattctctgcccttacagagctaacgaaggagatggccaaacatgtaagtaaaagaaaggatgataagggataggggagcacatgtcagggctactgacttcgtttaatagggatgggggtttgaacaaggatcagagaaagatgaatagaaaataggcaaaggaagaatgtgtggcatcagggagggtgaaggacagtgtgtttg

SEQ ID NO: 328071 - DNA, 196 bp, Homo sapiens
  misc_feature (14)..(14): n is a, c, g, or t
  misc_feature (20)..(20): n is a, c, g, or t
  misc_feature (23)..(23): n is a, c, g, or t
  misc_feature (27)..(27): n is a, c, g, or t
  misc_feature (33)..(33): n is a, c, g, or t
  misc_feature (40)..(40): n is a, c, g, or t
  misc_feature (53)..(54): n is a, c, g, or t
aaaggggggggaantttggnttnaaanttaggntttgggnggccccccccttnnagagataacctgcactggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328072 - DNA, 1024 bp, Homo sapiens
  misc_feature (883)..(883): n is a, c, g, or t
  misc_feature (894)..(894): n is a, c, g, or t
  misc_feature (896)..(896): n is a, c, g, or t
  misc_feature (900)..(900): n is a, c, g, or t
  misc_feature (935)..(935): n is a, c, g, or t
cccccccccccccccccccccccgcccccccgcacctaacggctaggtcgaggctgggttggcatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagtttgtcttagaatttcactttgaaccaatggatttttcaatgagggtggcaagactacgggngggtgaaccgngnttgntccttcttgaggccaattggtggcgggcaaatggnaagacaggtgaataaaagcaaggggggagtggaaaaaaattttggccaaaagaagaaacgcaatgtcattctaggtggcaaatatttcg

SEQ ID NO: 328073 - DNA, 963 bp, Homo sapiens
tagactcagaagtcttcactttattctttctcacctccactgtgaagtaaagaaaaggaaactccaaagatagtataggctagtattgttgctccacagccataagggatccaggactcttctgttttcctaactcctttttctttagctggtggctttcattctctaggatgcctcctggtccagtgtggctgctggagcttgagccatcacattcatattctaagtgggagggggagagggattaagataaaggcttcccagctatctaccatcctgttaaggatacttcctcaaagaaatacagcatttctgcttttttatcttgctgtcaaaatagtgtagctaaaggtaggctaggaaatgtagacttttagcttggtgtgttgccatctcatataaaatgagaatgttgttactaagaaggaaaagtaaaatcagtagatattcggttgaatgcacgtacttgttgacatcacattccccaaaaacctgcaaaaccaattttataaagcttcaaaagtataaactttacatttgaccagatgcttttaatgaaagtgtaagcacttccagtgtgtacttgtttacatatgaagttagaaaacggaattaccttttgaatttcctatttcatgtctttgaaagagatactaattttgaaaatgaattttaagtttttctgtaactttttttggtaattggtacatttgaaccttggtgtgatactatgatattatagcaaagaacagtctgaacttgatcaagatttggatgatgttgaagaagtagaagaagaggaaactggtgaagaaacaaaactcaaaggtattactttaaattacttcaggagccagtgattgctggcacatgtctactagagggtagttataagtaccagtctatttttttggacccttgctcattgtcccatttatctactggtccatacttctagtgtgt

SEQ ID NO: 328074 - DNA, 796 bp, Homo sapiens
  misc_feature (14)..(14): n is a, c, g, or t
tcagctgtacgccncggagtatgggatatcgtcgacccacggcctcgaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328075 - DNA, 1000 bp, Homo sapiens
gaggactcccttacagagtagtttcagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaatttaaaacaacacaaaaaccttcgcaggcattctatgcccgggtgcggcagacacgcgggtccatcgacactcgccccgtgcgtccatagcgcggtccccggaccccagtttcttcggtacaacggggtacgttcggcggggctcccaataggtagagaccgactcaacatcaggttcaaggccagggtcaaccttgcttaaccgaaccgggaacaccaccgcacacaccacggacgccaggacaaccagctctccacagagccagacaaacgctatcgcgacgacggaaatgcacgcgagaactttaggtctgggtaatataaccaataagctgaacgacgacggagaccaaccaagatggatgatggggagagacagaataatagaatcaggagatgaggaaaaggacgacagtctaagtgcaggcgtaagacaatatcagacgggaccaacacttgacatcccaggaagagagagagagagtggatgatagccaataacgagactgaggggaaggggcggagacagccgaggagtggaggagaagggcagacacaagtc

SEQ ID NO: 328076 - DNA, 205 bp, Homo sapiens
  misc_feature (41)..(41): n is a, c, g, or t
ttaaaaatttaaatttcttctttcttcaaacccttttgggnggaaaaacggaaaaagctaattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctc

SEQ ID NO: 328077 - DNA, 2023 bp, Homo sapiens
  misc_feature (1859)..(1859): n is a, c, g, or t
gcagaagagccatttattaaatgtaggtaatattcacaatttattttagcagatatttttaatgggagtggtggtgggggattgtactacttagggtatgtcttgtagatctgcgccaagaatattaaggtaccagatgactcagcttttcatttttaagccggatggaagttaattgtgaaaagacttcagaacttgtattaatagcttcagcttttgtttagtaacattttcttaacagatacagaactgtatcctcagtgaccaatattgatatttaaaaatctgtattggttatcccggctgtgtgtacatcatctagtaattgaattattatcagaagtaaattgacctcaaaaaaagtaattgggaaaattaagtttatggcactttgtgtaataactgtattgatgatgaagagaaggttagtactgtaatttgttttgtataagtctagtgcatatttggattgagtatgtttttaaaaagccattgaaaaccacattttgtttggctttagttacagtctttgactgtcccaactattaactttattaactttattcatacacatagaaatacattacacaagcatcaaacataaacattcagatcactcacttcatctttctcctgggcctaaaactgtcagtatatttgcagttttctgatatgtgttgtctgcattcagaggactgtcaagagtcatagataggcatctgaatgaagctttgagcttcttaaaatgcaaggtgggtgaaacacaggataccaggaagagaaaggatattgttcatatagttgtggcagtggccttgagaactgtcttgactagagatagattaggaatctgaattattcctgaacattgggttttcctttagtgtattctctttagctttccctgcccgtctctactcattagatataccagcaatttatgggccagttaggaaaacttcatgagattggattgtcctattaaaaaagcataatacattttcataaaatccttctttcgatgcccttttttttttaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagggccnccgaatctgagatggacggcgtgtgcgagcctcctctggacctcaatgggctttaggagggtaccccgaaggttttacggacgctcagcgacagtatcttacaggagggggcgagaggattctaccaaaccaaccatggacctgcccgaccacttgtctaagaa

SEQ ID NO: 328078 - DNA, 497 bp, Homo sapiens
cagcacagcttagaagttacagtgtggatccgctgtgtgaacctgatgagttctttgagaaactctttgagtttctgtttgacctctttaacaacaagagcaaaactccatctcaaaaaaaaaaagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328079 - DNA, 752 bp, Homo sapiens
ggacgcgtgggtcgacccacgcgtcgagagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaacgggcaaggaagaagggagatgaggaaaatgatcagactatggacccaaagaaggatcaaacccagcagagtgcagcagagtgaagcaggatggtctaacttctgcttcccta

SEQ ID NO: 328080 - DNA, 727 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggaggatattaattttaagtacctgtgaaatgaagttcttaaaacctaagattccccaaaactccagttatcaacaaggttatataggaatcaaagcgaggcgtttggagtagatgccgagatcacctctccctcacacctctgctgaccccagctacctgcaatcctgccaggaccattctg

SEQ ID NO: 328081 - DNA, 5382 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328082 - DNA, 5358 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328083 - DNA, 3992 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaat

SEQ ID NO: 328084 - DNA, 6165 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328085 - DNA, 6670 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328086 - DNA, 6440 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328087 - DNA, 3282 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggaggcctaccttgaattaagggttatactcagtttttaacacattgttgaagaaaaggtaccagctttggaacgagatgctatactaataagcaagtgta

SEQ ID NO: 328088 - DNA, 3540 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaatcatagggggtcaagagcgctaagaagaaaaggcgcccaaaggcttctatgggtgttccttaataatactaatggggtaaaagagtttgagagcgtttgtgaccttatccccggggctgctatgggtcaccgggtgcgacttaacaatgggggtaacacgtggattaccccttaaaaatacacctcaagggacagtgatgattaagaggcgaatattgggagattataacacttctcattttaagggtgtttctccaaactcttgtgtacaacaagcctctaaagaatatttgggggcccatactaggggaagactgccccagcgtgttgtacacttaaagcaactattgtggtgttacagaccacaggggacttttgagcaatacagactaagccgtgtgggaaaaaaaccacaggggttgtcttaagtaatgccctctctgtgtatgaacggaggaataccggtggagaagataaggccacacccctttatacaagaactctcgggaggtgcgggccccccaaagttataaataaaaaacggggccgcggaaatcgccccaactataccaacacgggggccccacgaaaatggagagtcaccagaatactatgagcggcgacaccggggatggcgggaagacaccaacaacaggggggcaacgcccactgtgacgacccacggcgccacatgcaggacctacaggcacgacactcaagcacacatgtgggggacacag

SEQ ID NO: 328089 - DNA, 6670 bp, Homo sapiens; identical to SEQ ID NO: 328085

SEQ ID NO: 328090 - DNA, 5261 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328091 - DNA, 6650 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaaggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328092 - DNA, 5367 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328093 - DNA, 2390 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagtta

SEQ ID NO: 328094 - DNA, 2527 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328095 - DNA, 2362 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaatttaaaaaaaaaataatatgagagataacaatgaaaaagagggggcggggcgcggcgttataagaatgttcccccccgcggggggcggcccatcttttacggcgttcgtccaggttttttttgtacaagttgggccccgtatagagggaggccggtattatatagggctaggagcactggcgccgctcgtgtttaacaccgtcgtcgggagtgtgggacaccatcggctacgcgtgggtgcctcttggggggagggggactccctcactttggtggggtggggcacatttcttgcgggccacacttcccctcacggggggattttatcggccctgagggggacatcctaacactttttcgacgggtgtcttctcggtgttacccctacgctgcaatattcttggggttggagaaggttgggcgaccgggattatgcttttcggacacttttctccggcc

SEQ ID NO: 328096 - DNA, 4736 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaaggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328097 - DNA, 1820 bp, Homo sapiens
  misc_feature (1793)..(1793): n is a, c, g, or t
  misc_feature (1808)..(1808): n is a, c, g, or t
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtctaccttctgnttccccttccacatncgtactgggccg

SEQ ID NO: 328098 - DNA, 6460 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgattcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328099 - DNA, 2339 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatggtctaccttctgcttccctggaaaggatgaatttacatcatttgacaagcctattttcaagttatttgttgtttgtttgcttgtttttgtttttgcagctaaaataaaaatttcaaatacaatttaaaaaaaaaaaaaaaaaaaacaaaaaaaaaaaaagcaacaacaacaccgacgcacacaccacaacagagacccaggcaaagccgcacagaaaacggaggcgagaggagaggcaccaagagaacggacaggccgcggccagccgcgaaaggcgaaacaagcagaggaggggggcgggtagacagcaccaatcacgaggaggcggcacgaaagcacggaacgacgcaggccacactacggagacagcacctagaggagagagaacaaccagacgagcgacgggcgagctagcaacaacagctgcggaggagaaaagacgagtggtcagtcaagagagaaggcaccaatgggggggacagtaaaacggtcacacaaccagcggatagccagctgcggagagatacaccacgggtaggatgcgagacacacatcgagctgcggcgagcagccgagctacaaatcg

SEQ ID NO: 328100 - DNA, 1864 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaagatcaaaccagagagtgcaagcagagtgaagccgatgttgtggctgagttacttgatggttactctgcttccggaaggtaattcctctttgaaagcttttcaagtattggggggggggtgtgggtaaaaaaattcaatacatttttaaaaaat

SEQ ID NO: 328101 - DNA, 1751 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctc

SEQ ID NO: 328102 - DNA, 1981 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctc

SEQ ID NO: 328103 - DNA, 1848 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcag

SEQ ID NO: 328104 - DNA, 1981 bp, Homo sapiens; identical to SEQ ID NO: 328102

SEQ ID NO: 328105 - DNA, 1582 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagtcctgagagtggagatctggatgatgatgctgaagctattcattactgctgagtgacatcgcgacactcggtacgtgcgctgtatatctcgtgaccac

SEQ ID NO: 328106 - DNA, 1692 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattgaaaaaaaaaaaaaaaaaaaaaaaaaacaaaatttggggggggctgggccgaaaaagattctataagaaccaattcggtgtggggcggcgggggggcccagagtaggggcaagccgtgtggacacgtgtggtcaatgacgggggtttcccaaggaggagaaccggggcgccaaggaacactagggcggggggttccccacacaattaaaaaaaacgcgccgggggggggcaccggggcggttcggggaaccaactcccaaaggggggtctcggagggccaccgggggaccctactaaaggggagtccaaggggagccgaatacaaattacggccgacggg

SEQ ID NO: 328107 - DNA, 221 bp, Homo sapiens
ttctccagattctgaatgttctacatctgggcacaagattaccgttctttcattgtaccatctcaggctcagtcattgttacttaagcaggccaccatgttgcgggactggtggggatgagcttgcaggctcagttgtcagtgtgagaactttccctttcctatgaccttccagatgaggaactgctcagatcaccagctgcttcaggttaccagcccaca

SEQ ID NO: 328108 - DNA, 204 bp, Homo sapiens
ctactttggcctcctgaagtgttgggactacagttgtgagccatcacacccagcctctaagagtcttacatgtgccaaattaagtaacacagttattcctaaattttctgcttttgttttcctttaaaaatagatgatgatgctgaagctatccttgctgcagacttcgaaattggtcactttttacgtgagcgtataatccca

SEQ ID NO: 328109 - DNA, 239 bp, Homo sapiens
atatctatttgatttttatttactttgaatctaccttttgcttcagataaaaaacctgtcattcactaactccaatgcttcagtttcagtatgacaaaagaagtgtgacttccattttactctgatgctatataactgatttctaacctttcagcctgcctagggtagttaaaagacgagtgaatgctctcaaaaacctgcaagttaaatgtgcacagatagaagccaaattctatgag

SEQ ID NO: 328110 - DNA, 387 bp, Homo sapiens
atgtctcagtcagctggtgtttgtgtagtaacagaacacagtcctcgaatgccatgttattcatttttattatttttttaatttgaaggaacacgatgaacctattctgaagcacttgaaagatattaaagtgaagttctcagatgctggccagcctatggtaaaagaactttgaaatatttataattttgtaacatgcttacaggtagataaatagaagcttttaaaaagataacattcaagggtaaggttggtgctctttgttatagtgaataaatatttggatgctgctaattgtgaggcagtatttattccttttcctccttctgatcataaattgtgtttgaaacacagacaatccttgttcctggataagtggataaaaat

SEQ ID NO: 328111 - DNA, 644 bp, Homo sapiens
cagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccggtaacggatgggggcctggaagggaagggggaacgtggtgttggctgggcggcctgcgcagatgggagggccggagggatggagggactgggagccgggagtcggggccgctggccgcccgtggcctccggggtcgtcctgtgaggtcggacaggaccgcggagtccggaccccggagcctgagaggggccccggggccgaccagcgcttttatcggggacggctgaggcgacgtaggggttggcgcggcctggaggcctaaggttctctgagct

SEQ ID NO: 328112 - DNA, 790 bp, Homo sapiens
gatgatgtagaggtcgtcactcggtttaatttcagtacggggctgggcgttaggcggacatattgctgggccgggcttgtcgatgtcagcagccgccctgagtcactgcctgcgcagctccggccgcctggctccccatactagtcgccgcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagtattgtttagaattcatttgaaccatgatattttcaatgaagtgctgcaagactcggataggtcgaccgatgtctgatccttctttgtgccgaatttggtgcgggccgaat

SEQ ID NO: 328113 - DNA, 509 bp, Homo sapiens
ccactcccgcccacccaacacccgcaggaccgcgtttgaatccggacgaggtgatccttttcttttgatggaccagaaacttatgggttgtacatggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctc

SEQ ID NO: 328114 - DNA, 388 bp, Homo sapiens
ccaccggcaggttgtactccaccggcaggggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaacccagcagagtacagccggtggagtacacctgccatggggccggcctat

SEQ ID NO: 328115 - DNA, 5430 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328116 - DNA, 5376 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328117 - DNA, 4756 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328118 - DNA, 5935 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328119 - DNA, 4728 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328120 - DNA, 2580 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328121 - DNA, 1906 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328122 - DNA, 2773 bp, Homo sapiens
  misc_feature (2160)..(2160): n is a, c, g, or t
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaacacacacaccactcggaggacagaaactcttcaggggattggactgcctggttccgctattcgacacacacacaacatgcttagacgtttccacttatctctngcgggcggtacagagcctcaagagagaagggctccaaaggcttcacaaagggggctctccaaagtccaaaaggggcacaggtttggagttatggacccagttaccccggggtagtctccggggtcaacccggggagccattctaccaacggcggtcagatcactggggacccctgatacgagccgctaatggagctgtcgcaagggccagatatcggggtaaaaattccaaaatacatggtcgtccactctgttaaaaggctcaacacatttgtgggaccaaattgtgacagatccccgttggtgacactagagtattgtgtacaccccagcggttgggataacaccaacgggtgacaccacaggctgtttagaaacactctgtctcgcgaaatttgagccacagacgcccatttgacgctcatcgaggggggcccaatatatatgaagacgcgggaggcgagaacgcattgtcgaaggggccaaagtcggtcaccgaaatttgtggcatggtgagtagaaacccgcggccctgtcgtgcagaatacacgaagtgcaaaccatcaccacccgacaatacttgccgcaacaccatacacatagtactaccaatc

SEQ ID NO: 328123 - DNA, 2790 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaatttaaaaaaaaaaaaaaaaaaaaaaaaaaaaaaaaaagaaaggggggggcgcgcggctccaagaaaagatatcccctcgagggaggggccccatgttatcggcgcgcatcagccccaggtttttgttggttcgaaaggggggccccctaaagggggagcgcctcaattaaagaaagcgaagggccaggggcgcgcgccgtgtaaaaaagcgcgctctcggtagccgggaaaaaagagcgggccaagcgtgggggagccccttgtggagagaaagcagaaacccctaacccttcgcgggggggcggcgacacactactgtgggcaacacgacaccaccctcaccagacgataattagaagcgcgctcaaggggacaaccatcgaaacacacttcacaagcgcgactatacggggggcaaccaaccacaggcggtgcataaaatgcagtggcgcggtcttgcaacaacagttgcggccaccacgaagaaattgcagctgtcgaggaacaagtcttatttaacgccgggggggcctctgttggtaaaaaataactgggggaaccaccagccggcaataggacaacagagctataggcaaggaaaaagaagagacagaagtacagagagatgatataacaacatagaaagcagcgcgaggtgactacacgcgaacaggagaccatgatagcgaaccaacagtccaggtgatgaaggcgatccgggaagcgaggggagcagaacacaggaaccgaacacaaaagacaagaaacgacgcagaggcaaggatgagagagggacgcagcagcgcgaacaaacgcaccacaaagaaggaaccgtaagccaacgaccgacgaacggcgcaaccaagccagaagaccgccacagcaac

SEQ ID NO: 328124 - DNA, 5221 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaaagaggaagaaaatcttaagtgattgatgctgttttcttttaaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgagttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgta

SEQ ID NO: 328125 - DNA, 1878 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328126 - DNA, 2411 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattt

SEQ ID NO: 328127 - DNA, 1848 bp, Homo sapiens; identical to SEQ ID NO: 328103

SEQ ID NO: 328128 - DNA, 1880 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatttattgaaaccttatacatacattgtttggctgtataaggtttcaataaataaattgcaaaactcag

SEQ ID NO: 328129 - DNA, 1602 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagtcctgagagtggagatctggatgatgatgctgaagctattccgtggtctccagacttcagcaatttgtcacgactgacgttgcgcgaacaagcacacagagcagtgctgatactatga

SEQ ID NO: 328130 - DNA, 1610 bp, Homo sapiens
gtggaagtgaggaagagggagagctcctgggcaccagaatgaatggggagggtcctttaggcactgtgaggcctttagcttttactcctactgagactggacatcgcaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacggtgccaggacctgtgataggtgctgagagagatgaggaactgctcagatcaccagctgcttcaggttaccagcccacacctgtctgtctcacctctgacaaccttggtaaagaaaccaaggcttagagacctgctcacagtcgtttcgtgagggaatgcaacatctgggtctagggtccaaatctatctctgctgtgaagaggaactcatacaggagatctacatgattaccaattcttggccttgcagtggagatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagtgatttcatagaagcaggaactgggagaattgtgcaggtgtcatttatctatgaccaataggaagagcaaccagttactatgattgaaagggagccagaagactgattggaggccctaccttgtgagtggggcatctgttggacgttccacctggttatatactctgcagctgttagaatgtgcatgcacttgaacacgcac

SEQ ID NO: 328131 - DNA, 818 bp, Homo sapiens
cgtctcaacacggttgcttgagattcctgatagcatggtggctagatcccaaaaaggagtgctccaagaagtaaagaagatgattcacctcagaccagcctgggcaacacgattcaccattacctttgggggcatgtttaaaagagatgctttcatgtccaagtctggaaatcccagcatctgtcctgtcttcaggtgattgaagaaactgcccatgggatcataacagaagccccggtgatagtcttctcagattgaaccacagcactaatggagattaccaaaatttataggataagattactgaaatttctatgttgttttatcccattgaaatcaatggaaagcaaaggacaggaaagagccaaacagacaattttcccctctcatctctatgatatggtccctccttacagttcttctggaaaagtccagagtgccaagcaaatatactgactctggggtcctgctgtgctgcatcgtggctcattgtgaaccagtggtcaatccaggaggccatctccatagatactttgcatcatttcctttccctccccttcaccactggggacttacacttcccaaataaaatatcaacaattcaatccatatccctgcattctagacgcttagcacactcccatgacccacatgctggtgaggatgttgagttcatgtgaagccttggtaattttggttggaaacatgtttctagaatcaaggcaatgtggtttggtcaaattcagatgagattgtggagccgcgtgtcctagattccagctttggctctagaccttataaaccaaccctgtggcctt

SEQ ID NO: 328132 - DNA, 337 bp, Homo sapiens
  misc_feature (20)..(20): n is a, c, g, or t
gcggccgcctactactactnctgctcgaattcaagcttctaacgatgtacggggacatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328133 - DNA, 3594 bp, Homo sapiens
aggcggagcgtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgaaaaaaaaaaaaaaaaaaaaaaaaaaaaaccttgtgggcgccgcgcccgggccccggaaagcttttaaacccatccggtggggcgcgcggggccccaatagggaactggagaacacatgtggcgcacacctggtgtcccctaaggagaaactccggggccatgctagacatacgggccgggagttctccccccatataaaaaaaaaccgcccgggggttacccccgagcgtgtttcggggaacaacttccccagaatgggcgctctccaggagcggggcccataaccggggggtctttatcacaacgaggggtctcccaaggcggcgcttccgatattccaacatttacccgccccgctcctcgttagctccatcagcgcgctctctcctgtgcctctctcatcatcctctctctctcgtctaccctcagtcctccttacttgcggcatagtcccctcagcgttgcccg

SEQ ID NO: 328134 - DNA, 1531 bp, Homo sapiens
aggcggagcgtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacgcggggcttgtgccaaaagaacttgaaccgggacttgccattctgggaaccctctgccggaatagggtcgtacctccccaatcaacaggggaccagtgcagtacccaaggaatctaacaagtgaaggcaaaaagagcatggacgagggcagcagtgggagcgaaggatgaaaagggggagaacagaaatgcacgaaagggggggatgaggagaggaagaccggcaagttcaaaaggaaaaggaggcacaaatacggagatacactaaggagacacaaggaaaacacaaatggaacaaacgagaaaagaagaaaaggaaaag

SEQ ID NO: 328135 - DNA, 137 bp, Homo sapiens
caaaggtaggtgctttctgcctaagtggagctcaaggtagcaaaaaataatggggatgagccatggcaccttgtcaggctggtgctataaagccatatgtacttttggtgtgcattattgggtactacgctttggca

SEQ ID NO: 328136 - DNA, 2639 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328137 - DNA, 2599 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggggaagatgtcaggggagaaga

SEQ ID NO: 328138 - DNA, 2296 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaccagaccccccttgatttcaggaagcaggaacgtggagggtta

SEQ ID NO: 328139 - DNA, 2606 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328140 - DNA, 2704 bp, Homo sapiens
aattcgcggccgcgtcgaccgagaagacgacagaagggggcggagagcggctgatcgcagtccggaggtgaggcggaactctgaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328141 - DNA, 2630 bp, Homo sapiens
cccacccccccccccctcacccaaactatgtatacgtgccgccagctcgttgttatattcagtgatcagggctggggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328142 - DNA, 2501 bp, Homo sapiens
tttttttttttctgttttagggacccatcggcggcacacgccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328143 - DNA, 2588 bp, Homo sapiens
aattcgcggccgcgtcgaccgagaagacgacagaagggggcggagagcggctgatcgcagtccggaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328144 - DNA, 2586 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttactcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328145 - DNA, 2461 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328146 - DNA, 2120 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaatccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328147 - DNA, 2208 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328148 - DNA, 2480 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgcttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328149 - DNA, 1389 bp, Homo sapiens
acccacgcgtcggagagattgtcctgtgatttctacccatttcctgaggcctgtggaaataaacctttatgtacttaaagttatacagaaaatagaataaagttaataccaaacttgaaaaaaaaaaaaaaaaaaaaaaaaaaatgattgtcctcttccctaaaaagggggggactttaggattccccgtcccggacgtaaaagaccacttatttgaacgccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328150 - DNA, 1390 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacgccagtcgccattcttccgagatgaattgtcttattcctacagaaaggccgtgactttattt

SEQ ID NO: 328151 - DNA, 1510 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggtctggagcttcggcgtgttgcacacgccgagtctccagacttgtcttccacaagcacgttcttaccttagccacgaagtgaccaagccacacgtactaaaggttgaactcaaagatatgtacagggtattaaacaaataccaagggaacagttaacttcaatacaaggtcaaaatcagcaacaagttctacaatccagtgctgatatcagatacaagcttcaaggacaatttcttttcgaaggcttgtcccagtttcgtttgggtactcggcgtgtgca

SEQ ID NO: 328152 - DNA, 919 bp, Homo sapiens
  misc_feature (795)..(795): n is a, c, g, or t
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccccntcaccgcatacgagcaaagggcccccgttgctcacacacagttttaaccagcttcacggtccagatgagtcttgttcaccgggaaacatgtccggcaattaacaagggagaacatagcgaatgc

SEQ ID NO: 328153 - DNA, 773 bp, Homo sapiens
  misc_feature (20)..(20): n is a, c, g, or t
gcggccgcctactactactnctgctcgaattcaagcttctaacgatgtacggggacatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328154 - DNA, 696 bp, Homo sapiens
tcaggggaggaggtcaatcgcttgccccccactttggcaaattggggactgaggactggaagggtggagagtaggcggaaccagcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328155 - DNA, 535 bp, Homo sapiens
tttttttccttttaaagtcatctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328156 - DNA, 1045 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacgcggggcttgtgccaaaagaacttgaaccgggacttgccattctgggaaccctctgccggaatagggtcgtacctccccaatcaacaggggaccagtgcagtacccaaggaatctaacaagtgaaggcaaaaagagcatggacgagggcagcagtgggagcgaaggatgaaaagggggagaacagaaatgcacgaaagggggggatgaggagaggaagaccggcaagttcaaaaggaaaaggaggcacaaatacggagatacactaaggagacacaaggaaaacacaaatggaacaaacgagaaaagaagaaaaggaaaag

SEQ ID NO: 328157 - DNA, 984 bp, Homo sapiens
  misc_feature (860)..(860): n is a, c, g, or t
aattcgcggccgcgtcgaccgagaagacgacagaagggggcggagagcggctgatcgcagtccggaggtgaggcggaactctgaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccccntcaccgcatacgagcaaagggcccccgttgctcacacacagttttaaccagcttcacggtccagatgagtcttgttcaccgggaaacatgtccggcaattaacaagggagaacatagcgaatgc

SEQ ID NO: 328158 - DNA, 689 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcactgttcgcgcagaattatcaggggggagagcattacacatgccctgaacatgtatctg

SEQ ID NO: 328159 - DNA, 524 bp, Homo sapiens
ataatggggatgagccatggcaccttgtcaggctggtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattgggagaaatgtgtgagatttagccccagctgttctttagctcagatttaaacctgctgtctcttctttatttgcagaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagca

SEQ ID NO: 328160 - DNA, 853 bp, Homo sapiens
tatttgtgcacatacatttgatatgtctttctagacatagaggataaggatttacatatccttatcctcacccacaatatacacacattccatgttgttgttaatggaaccatataatttaatcttggggagaagagaaatgataaaagtacttttccaaaactgcttgcaagagaacatctcaaaggctctggttttggctttgaattttctgttaaggatgtttaacatgacgatagcagctcaaaggtctggtatgaaggacaggaacaaggtagctgttgttcttacagccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggtgagttaaaaatacctagacaggggcaggtatttttattattttatttttttgagatggagtttcactttgtcgcccaggctggagtgcagtggcgcgatttcggcttaccgcaacctccgcctcccggggaaaaggagtaggaacaggaggttaaatggagcttagctagatgagggcagagttctggcttcaattgcaagaacaaaaagtttgggatagcctggttattttttgttcggtgtgtgctttgtgatgagaatcctgggatctctctctaacagttaaaaacagaagggactgaagatttctggcattgaagaaagctattttatgaacattctgcactgagcaggtaaaaacccaataatgcac

SEQ ID NO: 328161 - DNA, 3108 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgaaaaaaaaaaaaaaaaaaaaaaaaaaaaaccttgtgggcgccgcgcccgggccccggaaagcttttaaacccatccggtggggcgcgcggggccccaatagggaactggagaacacatgtggcgcacacctggtgtcccctaaggagaaactccggggccatgctagacatacgggccgggagttctccccccatataaaaaaaaaccgcccgggggttacccccgagcgtgtttcggggaacaacttccccagaatgggcgctctccaggagcggggcccataaccggggggtctttatcacaacgaggggtctcccaaggcggcgcttccgatattccaacatttacccgccccgctcctcgttagctccatcagcgcgctctctcctgtgcctctctcatcatcctctctctctcgtctaccctcagtcctccttacttgcggcatagtcccctcagcgttgcccg

SEQ ID NO: 328162 - DNA, 2581 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctggagggagttcgtcaaagcacgagctcagaggatgtgaaagttagattgcagggtgatgcaggtattgtattatgaaagaattaggcaaagcagggataagagtacagtctcacggagctcttgcctgtaggacggaaaggtatacaaaatataaacaggttataggtggaagagaggtgtattgagattactactatagtacatagtgctcggggaaagtagc

SEQ ID NO: 328163 - DNA, 2621 bp, Homo sapiens
aattcgcggccgcgtcgaccgagaagacgacagaagggggcggagagcggctgatcgcagtccggaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328164 - DNA, 2616 bp, Homo sapiens
  misc_feature (5)..(5): n is a, c, g, or t
  misc_feature (8)..(8): n is a, c, g, or t
  misc_feature (22)..(22): n is a, c, g, or t
tggcnagnacgaggccggtgtnaatcggcaccgaggggagagcggctgatcgcagtccggaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328165 - DNA, 2555 bp, Homo sapiens
  misc_feature (5)..(5): n is a, c, g, or t
  misc_feature (8)..(8): n is a, c, g, or t
  misc_feature (22)..(22): n is a, c, g, or t
tggcnagnacgaggccggtgtnaatcggcaccgaggaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328166 - DNA, 2603 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaacagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328167 - DNA, 2121 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaaggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328168 - DNA, 2593 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328169 - DNA, 2432 bp, Homo sapiens
aattcgcggccgcgtcgaccgagaagacgacagaagggggcggagagcggctgatcgcagtccggaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 328170 - DNA, 1462 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttgcagcgctacggtaccggctcgg

SEQ ID NO: 328171 - DNA, 1323 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatggtaataccaggaccgagctcga

SEQ ID NO: 328172 - DNA, 967 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctcccccacgataccagaaagggacccgatcggtcgcccaggcgtcacaaagtcaggctcagaagagtctggtacccgatcagcacgggacgagcagaattaaacagggggcgaggcataacaagtgcccggaaaaatgtagctgaggacagacgaacgaagaaaccatgcgaaggtcaaa

SEQ ID NO: 328173 - DNA, 993 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacgtgggccttggaagccactaacggtggccttgtgcgctacagaacctggagctggactgaccatcttggagccttctgtccggatctacgtgtcctactatccacaataaacaaatgaacccaataaattactccacaaaccgcacacaagctacagcacacgacataaacatgaccacacacacaaaaagagaaaatacaaaaacatagcgcacacctcaacatcgcccacaacaaagaaacaatacaacaccgacctacacacgaca

SEQ ID NO: 328174 - DNA, 892 bp, Homo sapiens
aattcgcggccgcgtcgaccgagaagacgacagaagggggcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatggtaataccaggaccgagctcga

SEQ ID NO: 328175 - DNA, 1369 bp, Homo sapiens
tgttgatacaaggaagagcttcaccagtggcttgctgtagagttttcaaattaactgaaccctttcctcggcttgataataatgggattcttcttcaacatacaacaaactttgtttttcttgggagattttaacagtgttacattctgaattttttaggttatgtccccatgtctcagctacgtgagactttctgcttttctgttagttactgggacctacccgtggccccactgttattgttactagaaagcctggcctaatgtgagaaataattacagataaaactttttttttcagtgctgccttaacaatttcaggaaaagactaaaatgcttccgatgtggagcagacaagtttggtaagactggattcagctgtttgcaatatgcattaaaacctactaactggggcagggagcagtggctcactgtaatcccaccactttgcaaggccaaggtgggaagatcacttgaggacaggagttcaataccagcctggcaagagatagcaagaccctgcctgtacaaaaaaagaaattttaaattatctgggtgtggtggcacacacctgtagtcctagctactcaggaggtttaggtgagaggattgcttgagtccaggagttgaaggctgcagtgagctatggtcataccactgcactccagcctgggcaacaaacaagaccctgcctctcaaaaaaaaacaaaacaaaaatctgacaaatagggttgttaactgtgagcctgaggaaaagtatagattttagtgtacttaaacaacttgtctgttttctttaaatcttttcccttaggttagataatgctgctcatgattgtgagagcacagaaagttcttttgttttctagaattaagtctgctcacctggtttgcattctgcatctgcctttctttagtgcagggtagtgtcagtcccactgtggcccaaagtttgcattctgcgttaaccaagtcacaattaatgaggttttactataggcacaaatgcttaaaaaagaaaaaaacgattgttttgtgtggttaaaataaaaacttgtggggattttaatgtatttctttggtgaaaatacattagttgtttgtctctaattggatcactttcccttctagactctgaacaggaagtgcctcctggaaccacagagtcggttcagtctgtggattactactgtgatagtaagttcatacacgatcttttggtcttcatgttaaaaattgacctcagttgtcaggagatggagaccatcctggctaacacggtgaaaccctgtctctactaaaaatacaaaaaattagctgggtgtggtggcacacacctgtaatcccagctactccgtctcaaaaaaaaa

SEQ ID NO: 328176 - DNA, 461 bp, Homo sapiens
tttttttttcaagactgtctcaaaaaaaaaaaaaagaaactgctacaagtattgatttgagtgttagaaacccaagagcaaaacagcccagcaggttagaacatgacccatatttctttcattgaggtattgggctgaactcttagttttggggttgtagcatttatgtcagtattatttggattcttaaaaattgggcttcacattttattcatactaagttcttagagcattttgcaatttgttattgttaccatatcttgactgtcagcctgtgtacttagggaaaaaagccctggaaatctcaaagcttttcaagcagtatttatgaatgactttggttatatgtgataacatctaatggaaatatttgtaggtggaagtaagagtaaaaggggtttgttacagggcatatagttgagataagatccttaatggctcattctcatggcacaggggat

SEQ ID NO: 328177 - DNA, 544 bp, Homo sapiens
  misc_feature (536)..(536): n is a, c, g, or t
tgttgatacaaggaagagcttcaccagtggcttgctgtagagttttcaaattaactgaaccctttcctcggcttgataataatgggattcttcttcaacatacaacaaactttgtttttcttgggagattttaacagtgttacattctgaattttttaggttatgtccccatgtctcagctacgtgagactttctgcttttctgttagttactgggacctacccgtggccccactgttattgttactagaaagcctggcctaatgtgagaaataattacagataaaactttttttttcagtgctgccttaacaatttcaggaaaagactaaaatgcttccgatgtggagcagacaagtttggtaagactggattcagctgtttgcaatatgcattaaaacctactaactggggcagggagcagtggctcactgtaatcccaccactttgcaaggccaaggtgggaagatcacttgaggacaggagttcaataccagcctggcaagagatagcaagaccccacctgcctcgtgccanattcttgg

SEQ ID NO: 328178 - DNA, 406 bp, Homo sapiens
gttgtgtctgttagccacgccaccttacccagaagagacagacactgtctcctgggtccctgttgagcagatagagtgagcgactggaaaatagaggagaggatatgtgacacctctcctctgttgcaattcctgctgagcttgggtcccttcaccaacacctccttccagctctgtgctagtgtttacaccctgtgtgtggttgcctggtatccaatggattctatgtggatgggcccaatgatgagctgttgtcatggcagatgtctgaactccatgacacgcccacctgttctggctgcctggtttatgtaaatagtctcagaacattttcatcactcgaagaagaaaccctgtacctgttaaacagtcactccccattctgtactctcctccagtaactact

SEQ ID NO: 328179 - DNA, 3307 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328180 - DNA, 6260 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328181 - DNA, 6238 bp, Homo sapiens
gcgtcgacggctacacaaaatgccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328182 - DNA, 6099 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatagatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328183 - DNA, 6944 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttggtaagactggattcagctgtttgcaatatgcattaaaacctactaactggggcagggagcagtggctcactgtaatcccaccactttgcaaggccaaggtgggaagatcacttgaggacaggagttcaataccagcctggcaagagatagcaagaccctgcctgtacaaaaaaagaaattttaaattatctgggtgtggtggcacacacctgtagtcctagctactcaggaggtttaggtgagaggattgcttgagtccaggagttgaaggctgcagtgagctatggtcataccactgcactccagcctgggcaacaaacaagaccctgcctctcaaaaaaaaacaaaacaaaaatctgacaaatagggttgttaactgtgagcctgaggaaaagtatagattttagtgtacttaaacaacttgtctgttttctttaaatcttttcccttaggttagataatgctgctcatgattgtgagagcacagaaagttcttttgttttctagaattaagtctgctcacctggtttgcattctgcatctgcctttctttagtgcagggtagtgtcagtcccactgtggcccaaagtttgcattctgcgttaaccaagtcacaattaatgaggttttactataggcacaaatgcttaaaaaagaaaaaaacgattgttttgtgtggttaaaataaaaacttgtggggattttaatgtatttctttggtgaaaatacattagttgtttgtctctaattggatcactttcccttctagactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328184 - DNA, 6338 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgtatgtgatgtgcacattttccagttcgtaagctggggccctggctgttttaagtaactgtgtgtttgccactggcaggaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328185 - DNA, 1880 bp, Homo sapiens
aaggattgtgaagatgatgagtgtagagggaaggttaatggttgatattgctaggggtgccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328186 - DNA, 6231 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328187 - DNA, 5939 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtgggtacttggggatccttctagagtctagca

SEQ ID NO: 328188 - DNA, 5756 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggcttgggacgaaagtgtcaaggcattacggctcccattgaggctcaagttcggctaaagggagctggcctaggagccaaaggcagcgcatatggtttgtcgagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328189 - DNA, 5491 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328190 - DNA, 5248 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagataccgagaaccgctactgctgcttcggtctctccttgg

SEQ ID NO: 328191 - DNA, 1611 bp, Homo sapiens
gccgaggagggtagattgcctgagcccagaagtttgagaccagcctgggcaacacggtgaaaccccgtctctactaaaatacaaaatattaactggacgtggcagcgtgtgcctgtaatcccagctagtcaggaagctgaggcaggagaattgctagaacctggcaggaggaggttgcagtgagccgagatcacgccactgcactccagcctgggcaacagcgactctgtctcaaaaaaaaaaaaaaatttagtagggttttcacccatgataagaaatctttaaattgatcagagcccacattgaggcatcatatcccaggatcggaggcccctacccactggccttctaggcaggagctccacccgtaattgcccctgctctgtcctgggagcacagcttaggtcagactcttgtagaccatgttcatcctgtttatgtgagttctgctgacattgagctatcctgtataatgtgtgcctgtaattaccagacctttcccagaccttcagaggaatactttggggccctttcctaggcgtggatgcttgctgagcaggcattgaggggtgggtgatttgcttcatctgcctgtgttccgtagcccattttattcctccagtccttatacttgctcctggtctcttctggagaaatccttgtcttcatatacagttttctctcttctgtctcctggtgggtggtcctgctgggtaaggagtgggcatggtgagaggtggagcagcccataccctacctcccagctgacagtctctgtgctttcccaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328192 - DNA, 5446 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaagtaaatgtgctgctttcctcctcaatttcactagaagtagtttcgcttagtgcatttatgaggcataaaatgaaatatttcctgcaaaagaatatatgactgagattagttttaacttcttcaaagccaccaaaatgtaatttttatatggagattgtaagttttaattgtagggttaaaaaatgttttgaggtataatatacacacaaaaaaatacacaaaacagaaatgtgcaattctttgaatgtttatacatgtctatacatttgtatattacatgtgtatatacaccaccatgtgcccagccctctgttcttgacatttcatataagtggagtcagacaatagattaccttttgtgtccagcatcctttactttgcctccctgtgtattcttgagggtagaatttagcagatgtatggagtgatgttttatttttggtggcatatataacttttaaaagggaaaaacaactttaacaccccataaataactctatttatgaccgggagctgtatatatagaacagtaataagtatttttaacaggaacttggcattgataggttgtggtttctgagagattgaagtgtgaagctgtgtgtgacgtgcctaagcaggccaagcctctgcatacctcttccatccacttctctcatttgtgaagcctggccatttatttccctgtcagttctttttttttttttttttttttcccgtcagttctctttggtggccttagaagttgtgtctgtaggctgggcgcagtggctcacgcctgtaatcccagcactttgggaggccaagatgggaggatcactaggtcaggagattgagaccatcctggctaacacagtgaaaccccgtctctactaa

SEQ ID NO: 328193 - DNA, 4751 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttggtaagactggattcagctgtttgcaatatgcattaaaacctactaactggggcagggagcagtggctcactgtaatcccaccactttgcaaggccaaggtgggaagatcacttgaggacaggagttcaataccagcctggcaagagatagcaagaccctgcctgtacaaaaaaagaaattttaaattatctgggtgtggtggcacacacctgtagtcctagctactcaggaggtttaggtgagaggattgcttgagtccaggagttgaaggctgcagtgagctatggtcataccactgcactccagcctgggcaacaaacaagaccctgcctctcaaaaaaaaacaaaacaaaaatctgacaaatagggttgttaactgtgagcctgaggaaaagtatagattttagtgtacttaaacaacttgtctgttttctttaaatcttttcccttaggttagataatgctgctcatgattgtgagagcacagaaagttcttttgttttctagaattaagtctgctcacctggtttgcattctgcatctgcctttctttagtgcagggtagtgtcagtcccactgtggcccaaagtttgcattctgcgttaaccaagtcacaattaatgaggttttactataggcacaaatgcttaaaaaagaaaaaaacgattgttttgtgtggttaaaataaaaacttgtggggattttaatgtatttctttggtgaaaatacattagttgtttgtctctaattggatcactttcccttctagactctgaacaggaagtgcctcctggaaccacagagtcggttcagtctgtggattactactgtgatagtaagttcatacacgatcttttggtcttcatgttaaaaattgacctcagttgtcaggagatggagaccatcctggctaacacggtgaaaccctgtctctactaaaaatacaaaaaattagctgggtgtggtggcacacacctgtaatcccagctactccgtctcaaaaaaaaa

SEQ ID NO: 328194 - DNA, 3715 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaaggtaagcatatgttcttcccaaatagacaaaact

SEQ ID NO: 328195 - DNA, 2856 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggacttagctttaaaaaaaaaaa

SEQ ID NO: 328196 - DNA, 644 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatgtaaggggaaatgacagttataaccagcagtcagtaggcacaatgaactttgagcttctaccattattttctcatgctattgttttatcttaagccaatagaggttgagtatcccttatccaaaatgcttgggaccagaactg

SEQ ID NO: 328197 - DNA, 1037 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagaggtgagtgaccagcggctgtataaccccccaaaacactctgagccttatagtaatagaaataacagccaggcagccaggtccagtggccccttcccataatcctatcactttgggaggccaaggcggccagatcacttgaggtcaggagtttaagaccagtctggccaacatagtaaaacccgtctctactaaaaatacaaaaattagctgagtggggtggtgggcgcctgtaatcccagctacttgggagactgaggtaagagaatcacttgaaacctgggaggcggaggttgcagtgagctgagattgtatcagtgctctccagcatgggtgacaaagcaagactccatcttcaaaaaaaaaaaaaaaagaaaagaaataatggccagggtttacatagggatcaccatgtacttttgagcacttgacttcatgaattcatttaggtctcagtacaacctgataaggtaggtgttattcccattttaaagatgaaacaatggggttatgataacatattagttctgtgttttgaaatgaatgataaatataagttgttggccaggcacagtggctcacacctgtaatcccaaagtgctgagattacagatgtgagccaccacacttggccgaacacttaattctaacatcttttcctcatatgaactttcccgtcccagaacaccgtcgaa

SEQ ID NO: 328198 - DNA, 523 bp, Homo sapiens
gcgtcgacggctacacaaaatgccgccgaaccttgttggaggttctggggcgcagaaccgctactgctgcttcggtctctccttggggtaagtgcggcggctgtctgtaacgacggtaggttcttgccatttgggctggcccccaagcctcccttgtcagctgccggaggcgactgatcagctccagccggttctgtagaggggctaaattaccccaggcgttggagggccgcgcccttccttgttgccagctctgtcagtttccagagggtgtccagccagctcagccttgggcctgcttctttctggctgtgactttgccccttgtggatacacgtcccctaatcttcagcccaacggagcagtggagccgtcgcctgtccctcgggcactccttgggagctccctggcagtctctggccgccatcccccgctcaactgcaactgaatcgccctctccgaaaagctgttcggtgatcgcccatctgcgggtttggaacctcttgggaggcgggaggggcat

SEQ ID NO: 328199 - DNA, 298 bp, Homo sapiens
gaatttggtatttcagagcagtctaaaaaaagcattcttcagatttaaaaatacttgaggggatagttttgaataggtgcattagacggttacaggttgaagtctgtgaacatttccagcagtgttttttctcccatgtagatgaaataccgagaccgagctgcagaaagacgggagaagtacggcattccagaacctccagagcccaagcgcaagaagcagtttgatgccggcactgtgtatgtgatgtgcacattttccagttcgtaagctggggccctggctgttttaagtaact

SEQ ID NO: 328200 - DNA, 481 bp, Homo sapiens
atggggatttgttaacatttcggatgaggcattactttatccaggtacatagccaccgccatcttcctattgtacatttccagtgacctgtcctccttttgtctccagaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaaggtggccatgcttctgagctgatctgagggggcgaggggaggcagtgagacaatttgagtgccctaacagtcctgacggttccaaaaatacctgccatctaatgatggccttacagaaagctgttcccgatgacagtggacggagtctggcagctccacacacatcaaactatagtttttatgtgattgtgtat

SEQ ID NO: 328201 - DNA, 359 bp, Homo sapiens
cagaacctccagagcccaagcgcaagaagcagtttgatgccggcactgtgtatgtgatgtgcacattttccagttcgtaagctggggccctggctgttttaagtaactgtgtgtttgccactggcaggaattacgagcaacccaccaaagatggcattgaccacagtaacattggcaacaagatgctgcaggccatgggctggcgggaaggctctggcttgggacgaaagtgtcaaggcattacggctcccattgaggtaagcagtggggtcaggtcttgatgtttgccaggcttacaggccggttccagagatgagatcagagcactcatagagcctgggagccaggagcagctttac

SEQ ID NO: 328202 - DNA, 463 bp, Homo sapiens
caagctatggagctgctgacttaagtgatctctgagatttatagcaattaatctctcttgtctcctagaaaaaataaaatttgaaccttttggagctgtgtgctaaatcttcagtgggacaatgggttcagacaaaaggtaagttactacagtacgtggctttgatctcaacatttcagtggggactgaactccttgtttaaaatagtttatcaaactaatatatgagtgttttgcgccaggcattgctaacgaacacctttatgatcctgttgtcacaaactacagtctagtgagagaattaaagtactgtgtgaacatgctgtgataaagtgtagggtgctcttagaacacataggaagtatgtctttttcttgttcacagccaggaaagcttcctggagaaaatattctctggaaggaagctgaaggataagaaagaattttaggcaaagaagggcaggg

SEQ ID NO: 328203 - DNA, 655 bp, Homo sapiens
tccaagaaggttggtaccaggaggctgtcaggcctagcactcaaggacctgactgctccacgcagttgacaaaatgtgattcattactaaagtgtgacatgcagtaatggggatttgttaacatttcggatgaggcattactttatccaggtacatagccaccgccatcttcctattgtacatttccagtgacctgtcctccttttgtctccagaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagaggtgaatgggaaactgtgccacaaggaagaggatattgggataattgcctttagcttttatttgtagcatttagttccagatcccaggggcagggtaggaggatttgtcatacccttgtcatctgaccattgtagttcatgtagcctagacccagcctctgtgtgccttgtgagcctcacattgtcc

SEQ ID NO: 328204 - DNA, 7029 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttggtaagactggattcagctgtttgcaatatgcattaaaacctactaactggggcagggagcagtggctcactgtaatcccaccactttgcaaggccaaggtgggaagatcacttgaggacaggagttcaataccagcctggcaagagatagcaagaccctgcctgtacaaaaaaagaaattttaaattatctgggtgtggtggcacacacctgtagtcctagctactcaggaggtttaggtgagaggattgcttgagtccaggagttgaaggctgcagtgagctatggtcataccactgcactccagcctgggcaacaaacaagaccctgcctctcaaaaaaaaacaaaacaaaaatctgacaaatagggttgttaactgtgagcctgaggaaaagtatagattttagtgtacttaaacaacttgtctgttttctttaaatcttttcccttaggttagataatgctgctcatgattgtgagagcacagaaagttcttttgttttctagaattaagtctgctcacctggtttgcattctgcatctgcctttctttagtgcagggtagtgtcagtcccactgtggcccaaagtttgcattctgcgttaaccaagtcacaattaatgaggttttactataggcacaaatgcttaaaaaagaaaaaaacgattgttttgtgtggttaaaataaaaacttgtggggattttaatgtatttctttggtgaaaatacattagttgtttgtctctaattggatcactttcccttctagactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328205 - DNA, 7281 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaagtaaatgtgctgctttcctcctcaatttcactagaagtagtttcgcttagtgcatttatgaggcataaaatgaaatatttcctgcaaaagaatatatgactgagattagttttaacttcttcaaagccaccaaaatgtaatttttatatggagattgtaagttttaattgtagggttaaaaaatgttttgaggtataatatacacacaaaaaaatacacaaaacagaaatgtgcaattctttgaatgtttatacatgtctatacatttgtatattacatgtgtatatacaccaccatgtgcccagccctctgttcttgacatttcatataagtggagtcagacaatagattaccttttgtgtccagcatcctttactttgcctccctgtgtattcttgagggtagaatttagcagatgtatggagtgatgttttatttttggtggcatatataacttttaaaagggaaaaacaactttaacaccccataaataactctatttatgaccgggagctgtatatatagaacagtaataagtatttttaacaggaacttggcattgataggttgtggtttctgagagattgaagtgtgaagctgtgtgtgacgtgcctaagcaggccaagcctctgcatacctcttccatccacttctctcatttgtgaagcctggccatttatttccctgtcagttctttttttttttttttttttttcccgtcagttctctttggtggccttagaagttgtgtctgtaggctgggattacgggcatgagccactgctcccggctgggaactaaactttttaaagaaatcatattctatttttactctagcagtgtcacacctctttgctaggtggttcatcacctttacttataccaaggtgtgcccagggtcttttctgggcaggaaatatcactagtccacaacatactttatcttttttttgacaaaatatgtaatcgactgacatagcagaaagtctgcattaattgttttttgtttgttgttttctagtactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328206 - DNA, 6340 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaaggtaatagcaggaatggccagtatgtcatgatgggaacttacctaaaacttgagtctcatggcttgtcctctgtttcccagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328207 - DNA, 3233 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328208 - DNA, 2844 bp, Homo sapiens
  misc_feature (391)..(391): n is a, c, g, or t
gagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaanagcgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328209 - DNA, 1886 bp, Homo sapiens
tgataccaaaatatagtttgaactgcgtattagcaggtgagcaggagcaccttcaaatgaatcttcaaattggaaaatactgctacaccaccatgttggggatggagttgcaaatgccagtcttctcccatcagggacatttaacacgaaaccacaataaggcatcatttatacccactaagatggtaaaaatgaaaaagatggacaataacacaggtgcacataggatttgaacctccgtgcatcgctgatgggagcaagatgcgcgcagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328210 - DNA, 6135 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328211 - DNA, 1405 bp, Homo sapiens
cgaaagtgtcaaggcattacggctcccattgaggctcaagttcggctaaagggagctggcctaggagccaaaggagcgcatatggtttgtcgggcgccgattcctacaaagatgctgtccggaaagccatgtttgcccggttcagagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaaaaaaaaaaaaaaaaaaagaaacaaaaaaagaacgacagaagaaaaaacagaaacaaacgcacgaacaaggcaaacacagcacaagaaaacaaggggggggcggggggggacgaaaagaatccccccggggggggcgcccacaatgggcggcccccagcttattgtggaagaaaaggggcggcccatagggggg

SEQ ID NO: 328212 - DNA, 5204 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagccagtcttctcccatcaggcctttaaacattcagcaatgcaagtaccataaggtggaattcattcctcatctgaaccaaaaagcaaaaatggtaaaacttttttttttttttgggaggagaagtctcgctctgtaattcaagccggggcgacagagaaagactccgtctcaaaa

SEQ ID NO: 328213 - DNA, 5235 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttggtaagactggattcagctgtttgcaatatgcattaaaacctactaactggggcagggagcagtggctcactgtaatcccaccactttgcaaggccaaggtgggaagatcacttgaggacaggagttcaataccagcctggcaagagatagcaagaccctgcctgtacaaaaaaagaaattttaaattatctgggtgtggtggcacacacctgtagtcctagctactcaggaggtttaggtgagaggattgcttgagtccaggagttgaaggctgcagtgagctatggtcataccactgcactccagcctgggcaacaaacaagaccctgcctctcaaaaaaaaacaaaacaaaaatctgacaaatagggttgttaactgtgagcctgaggaaaagtatagattttagtgtacttaaacaacttgtctgttttctttaaatcttttcccttaggttagataatgctgctcatgattgtgagagcacagaaagttcttttgttttctagaattaagtctgctcacctggtttgcattctgcatctgcctttctttagtgcagggtagtgtcagtcccactgtggcccaaagtttgcattctgcgttaaccaagtcacaattaatgaggttttactataggcacaaatgcttaaaaaagaaaaaaacgattgttttgtgtggttaaaataaaaacttgtggggattttaatgtatttctttggtgaaaatacattagttgtttgtctctaattggatcactttcccttctagactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaagaagagagagagaaaatataggagagaatcatcattcccattttacagatggtgatactgaggttcagtgttccacgtcacatagctatttagggggaaaaccaggggtctaacgcaggccttctgactttggtcctggtgagaaaaaaagattgatgtttaggaaacagctttgcccctccaagccaagggggccttgcgaaaggtaatggtgaagcacacagcctcgtgccaccaagctggagagtgaatcctgatttgctggctgtgtgaccacaggcaagcctagctctat

SEQ ID NO: 328214 - DNA, 2658 bp, Homo sapiens
tgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagttcaagcgattctcctgcctcagcctcctgagtagctgggattacaggtgcccgccaccacgcctgggctgatttttgtagatatgaggtctcactatgttgcccgggctggtctcaaactcctgggattcaagtgatcctcccacctcagcctcctgagtcactggggactattcagacttgcaccactggcacctgggctgttagccagaacaattttttaaaggagg

SEQ ID NO: 328215 - DNA, 380 bp, Homo sapiens
aaaaaaaaaattgcagtgaacattaccatggagtgcttgtgtaatctctgtacacttcctgctaaggataatttctaggagtggagggtctgtttcaaagagtacagggtgatgttaattgtgattttgtttattgtaactcagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatgtaaggggaaatgacagttataaccagcagtcagtaggcacaatgaactttgagcttctaccattattttctcatgctat

SEQ ID NO: 328216 - DNA, 1556 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtgga

SEQ ID NO: 328217 - DNA, 2870 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328218 - DNA, 1975 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgagaacttggatattcagtatgtagttcactatactagaaatagtacagtcacaaccaacacacacatacacctatttaagcccagaatggtcgac

SEQ ID NO: 328219 - DNA, 1565 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaatgtagaaattacttttattatgttaaaatattccttaataaactagcaattatgtcgacgcggccgcgaat

SEQ ID NO: 328220 - DNA, 1888 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaagagaaaaataatgtccatcctgtcgtgatgtgataggagcagcaccaccaggacctggtggtgctgctgtcctggtggtgctgctgtcctggtggtgctgctgtcctggtggtgctgctggagtagctggaccctctttggggaagggcagattcaccactgaaggagtgggggtctctttggggggtagtgttactcctttgggagacagaggagtcacagctgagggagtaggggcccctttgggggatggaggagtgggagaatgcgtcgtggctggtgagtctttagagccttggaaagaaagactattctctggaagaaatgaagcttcaactggagaaacaggggatgagagatttccaataggagtatcagggccagcagaacccttcttggttggaggtcttttagtctgaggagacacatctaacccctaaaggagatcggggtatctagctag

SEQ ID NO: 328221 - DNA, 2775 bp, Homo sapiens
agccggtggtattcagaacagcctgagcaaaagaatttcttcaggcatatgttaagcatgcagatttcttggaccccatgccagacctgctgaatcagattctctcggaacttgtgttcttaacctgctcttgcatatgcactgtagaaggccattaaatatttgatgagtacaactttttaaccaaaagatacttttctatctgaccaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328222 - DNA, 2550 bp, Homo sapiens
  misc_feature (24)..(25): n is a, c, g, or t
tggcctactggaaaagaatccgtnnacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328223 - DNA, 1042 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagttgggcctggatgtttacctcagattttgtatacctccgggtgtcctggatgacgagggggaggccatcctgagtttggagggagctaagcggctgggggtccgggggcagccgtggaaaccgggggaaagcccccccccgggaggccagaaggggctgggggaggagcccccgctgt

SEQ ID NO: 328224 - DNA, 2180 bp, Homo sapiens
gggaggcagagcttgcaatgagctgagatcacgcaactgtactccagcctaggcgatagagcgagactccgtctcaaaaacaaacgaacaaacaaacttagcatttagctaaagagttctacttcatttttcagtttcatagttttctgttctgatatgctatccctatttcattgttaaatttaaaaccaaggaaataaagtcctgtattagtttttttcttccttgaatatcatgattatagaaatctttgctgatgtggacctaaataagcttgttgttgagacttccagagttctgtcctgggtagtttaaaagtctcaattggccaaaactttaatgaggttttagtaaatcttaatacagaggaagggaaatttcaaaagtatttacttcttcactgaaaggtgttggtcaaattcttcatctccatgctattttggagtttctcattactctttaactcatcaaaaaattcattcttttaaatgccttttgtcctcagctaagtaacaagcatactgcagaaatttgttgaataaattaatgtgtgatttcttttaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328225 - DNA, 2739 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328226 - DNA, 2297 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328227 - DNA, 2394 bp, Homo sapiens
  misc_feature (4)..(4): n is a, c, g, or t
  misc_feature (1962)..(1963): n is a, c, g, or t
  misc_feature (2078)..(2079): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttcnntcagcatgctgtattcaataatcacatctttacgtgcctcctcgaatgtgcatgatgccatccttacggaatttgcgggtacacggtatgatacaatggcacatgtacctccctnntaaacgataatatacacatgaatgctggacttcgggtcctcgattaactattgtcactcgatggctaggatctgttctttaatcaacggggactgagacccttaaaagttcaacgttatgtttctgaggtttcagacacccaccactgccctgcttcctttccctttcccttgcagaatgaagataatgggcagcaaaccgtgacaatcatgacacgcataaaacaagacaatttccacacaaatgtagaaattacttttattatgttaaaatattccttaataaactagcaattatgtcgacgcggccgcgaat

SEQ ID NO: 328228 - DNA, 1687 bp, Homo sapiens
  misc_feature (4)..(4): n is a, c, g, or t
agcngcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtgga

SEQ ID NO: 328229 - DNA, 2604 bp, Homo sapiens
  misc_feature (24)..(25): n is a, c, g, or t
tggcctactggaaaagaatccgtnnacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacctaaatcttcctggtggt

SEQ ID NO: 328230 - DNA, 290 bp, Homo sapiens
cctgcgtctcccctcttcctttatccttttgcttttctttctccagtttctttaaccagacttcctctctctctctctccctgacttggccctttggaatgcgtcccatcccatccctccttggctggcctcccccgcttccctttctactccagattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328231 - DNA, 2723 bp, Homo sapiens
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328232 - DNA, 2614 bp, Homo sapiens
attggctcttctggctcgccttccatccctgctcctgcaccggtctgcatctcccagcagaaggcgcagccatgaatccgttattcggccccaacctcttcctcctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328233 - DNA, 3380 bp, Homo sapiens
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggttagtttgatctcacgcaagcttattaatgtcccagtcccagtttctaagctgcctaggcctcctggccctcagtttgggcccgctgggctcttgagcacggatttttttctgccctttcccttttccttgctcttccccctttttctctctatctcttgttctcttgactgcatttctttctctcccttctcccccggctttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328234 - DNA, 3492 bp, Homo sapiens
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaagcggaacgatggagtacactggtgctggatccatgctgcaagacctgtgtaatatgagctccagcgaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggttagtttgatctcacgcaagcttattaatgtcccagtcccagtttctaagctgcctaggcctcctggccctcagtttgggcccgctgggctcttgagcacggatttttttctgccctttcccttttccttgctcttccccctttttctctctatctcttgttctcttgactgcatttctttctctcccttctcccccggctttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328235 - DNA, 1607 bp, Homo sapiens
  misc_feature (1536)..(1536): n is a, c, g, or t
  misc_feature (1544)..(1545): n is a, c, g, or t
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagtggagttggcagngcaagaannaatgaccggcactgccgagtacctgggatgtgccttaaacgcggctggacttcgatgggact

SEQ ID NO: 328236 - DNA, 1684 bp, Homo sapiens
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagaggcaaagatttccaggaaaagcagaggaaacaatggtgtattcgctgccttctgccttggtctggtttattttaaaatctgagccttcagtaatggctgcctgggcccccggcccagccactgctcttggcgtgttggcctcctggcgggggcaacagaggc

SEQ ID NO: 328237 - DNA, 2829 bp, Homo sapiens
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328238 - DNA, 2720 bp, Homo sapiens
attggctcttctggctcgccttccatccctgctcctgcaccggtctgcatctcccagcagaaggcgcagccatgaatccgttattcggccccaacctcttcctcctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328239 - DNA, 3163 bp, Homo sapiens
attggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328240 - DNA, 1451 bp, Homo sapiens
cctgcgtctcccctcttcctttatccttttgcttttctttctccagtttctttaaccagacttcctctctctctctctccctgacttggccctttggaatgcgtcccatcccatccctccttggctggcctcccccgcttccctttctactccagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacatgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaatttgg

SEQ ID NO: 328241 - DNA, 1622 bp, Homo sapiens
tgtgtggccattaatctatgacttagaacagggattgtagataagcttaatcggccacacccagcctgtgattgattcatagtctcttcttggaacactgtgttgagaaggattctgaggccagccatcttggctcagcagggaagagtgctgtggtgagtgagggattttgccatggagaaggagaaggacccatagcagtttgtcaggttcatggaatccgagctggacctaaatgacatcattcaggagatgcacgtggtggccaccatgccagacctgtaccaccttctggtggagctgaatgctgtacagtcgcttctcggcttgctcggacacgataatacagatatcctttcagatctgacctcagtaggagagctgacatggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328242 - DNA, 912 bp, Homo sapiens
ctctctgtgtcacccagactggaatacagtggcatgaccttggcttactgcagcctcctgggctcaagtgatcctctcacctcagcctcctgagtagttgggactacagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctgggatgggccaggtggttagcactggtgggtaacagaatcttggagcggctgggatgagtttgtgaaagacggaggcacgaatgggtctcacaaaattctgctattgggggacacatggttgagtcgggctgagatgtgaccgaaggtggccactagggttttacaggggctgtgaaacaggtcgagcaagatgccttagtgcgacaaatgatgttaggatggtgagcattgcgggaggtgaaaggatgtggatgatgaaaaggataaag

SEQ ID NO: 328243 - DNA, 556 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (56)..(56): n is a, c, g, or t
cctttttntcccccccccganaanangangnccccgnggttttttttttttttttntttttttttttttttaccaaaactagctttaatttgtccaaaagccacacagagttgtgtagaaactgatcctgggagggaagctgagagagtccatgatgcgcagggccaaggtgcctctagaagttctccagcaagcccaggatgcgcttttgctcgttctcccggaactccgggctccggccgtccccgatgttctctgcatactccttgatgatatgcctgacaattttgatggagcttcctcgcatgtttaggatctggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccgcaaggagaggacagcgattctcgtacgaacggttacgattcga

SEQ ID NO: 328244 - DNA, 631 bp, Homo sapiens
cagtccttttgcaagggtctaatccccctagattagacctaatctagacctaatctaatcttataattagatggtaagaacctaatcaccccataaaggccttcgatgcgttgaggatgaggtttcagcatgagttttggaggggacacaaacattcagaccttagtagcatccacgccatgtgtgttgagtgaataaatacatgagggcggaagtgaagggtgtggctaggaggggaatccaagcatggaaaggtaagttgggacctttccactgaggcctcaaaggcaagaccccaaggaatttggctacagtgggggcattagggcgacttgcacctctgtgggagctggggttctgggaaaggtatgaagcgacgcagccacggtggatgccatgcctgggatccactcctgactctatctttgtccccctagagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328245 - DNA, 406 bp, Homo sapiens
tgtgtggccattaatctatgacttagaacagggattgtagataagcttaatcggccacacccagcctgtgattgattcatagtctcttcttggaacactgtgttgagaaggattctgaggccagccatcttggctcagcagggaagagtgctgtggtgagtgagggattttgccatggagaaggagaaggacccatagcagtttgtcaggtattggcttctcctattgtagtagaataatgataaggggaattatttagcctatattaacaacaacagcaaaatgaatatagaactatatactatataggcttactttttggggggaaagtctgtgagttgagaagaatgacttaaacatacaggcaaacatacagggtattgaagctcatggtgctagctcttca

SEQ ID NO: 328246 - DNA, 2204 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (56)..(56): n is a, c, g, or t
cctttttntcccccccccganaanangangnccccgnggttttttttttttttttntttttttttttttttaccaaaactagctttaatttgtccaaaagccacacagagttgtgtagaaactgatcctgggagggaagctgagagagtccatgatgcgcagggccaaggtgcctctagaagttctccagcaagcccaggatgcgcttttgctcgttctcccggaactccgggctccggccgtccccgatgttctctgcatactccttgatgatatgcctgacaattttgatggagcttcctcgcatgtttaggatctggtgaaccctctggcgaatctgggggacattggcattgcaggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328247 - DNA, 1949 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtaaaacaagaaaaagcaaaggcctcggtgggctcaga

SEQ ID NO: 328248 - DNA, 1944 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtaaaaaaaataaaactttaaaaaaaaacctca

SEQ ID NO: 328249 - DNA, 2122 bp, Homo sapiens
tcagcgcgctgatagcctgctactgcattctgggaactacctgatgacctttcagtagcatgcctttgtactcttaagccattaaatgacaggttccatgtttttggagccaggaatcctggctattacaactgacttatattagatggtgcagggcaaacagagatgaagcattagcatggcatctgataggtaagtagtgatgatgggtagtaacactggacgtgggcgaacttctgagctaccaggagggtcattgcgaggagcagtagagctgcactgccgaatgtcgtagccactagccacataggctgttgattgcttgaaatgtgactagtctgaattgagaaatactcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328250 - DNA, 1537 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgtatgtatccctgcctcacttttgccag

SEQ ID NO: 328251 - DNA, 1419 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctgcttccctcccaggatcagtttctacacaactctgtgtggcttttggacaaattaaagctagttttggta

SEQ ID NO: 328252 - DNA, 1541 bp, Homo sapiens
gcgtgaatgcaaagtagttctgttcttagtgcctgggcataggtttgttgaaaggttcaggtatagaaatgttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328253 - DNA, 2018 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (56)..(56): n is a, c, g, or t
cctttttntcccccccccganaanangangnccccgnggttttttttttttttttntttttttttttttttaccaaaactagctttaatttgtccaaaagccacacagagttgtgtagaaactgatcctgggagggaagctgagagagtccatgatgcgcagggccaaggtgcctctagaagttctccagcaagcccaggatgcgcttttgctcgttctcccggaactccgggctccggccgtccccgatgttctctgcatactccttgatgatatgcctgacaattttgatggagcttcctcgcatgtttaggatctggtgaaccctctggcgaatctgggggacattggcattgcaggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328254 - DNA, 659 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (56)..(56): n is a, c, g, or t
cctttttntcccccccccganaanangangnccccgnggttttttttttttttttntttttttttttttttaccaaaactagctttaatttgtccaaaagccacacagagttgtgtagaaactgatcctgggagggaagctgagagagtccatgatgcgcagggccaaggtgcctctagaagttctccagcaagcccaggatgcgcttttgctcgttctcccggaactccgggctccggccgtccccgatgttctctgcatactccttgatgatatgcctgacaattttgatggagcttcctcgcatgtttaggatctggtgaaccctctggcgaatctgggggacattggcattgcaggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacaggtccagggcagaggacgtcgacgcggccgcgaatttagtagtagtagtaggcggccgc

SEQ ID NO: 328255 - DNA, 679 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (56)..(56): n is a, c, g, or t
cctttttntcccccccccganaanangangnccccgnggttttttttttttttttntttttttttttttttaccaaaactagctttaatttgtccaaaagccacacagagttgtgtagaaactgatcctgggagggaagctgagagagtccatgatgcgcagggccaaggtgcctctagaagttctccagcaagcccaggatgcgcttttgctcgttctcccggaactccgggctccggccgtccccgatgttctctgcatactccttgatgatatgcctgacaattttgatggagcttcctcgcatgtttaggatctggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328256 - DNA, 829 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtgggaaacatggctgagttccggcccgttctagggatcctctaggcag

SEQ ID NO: 328257 - DNA, 571 bp, Homo sapiens
acagtgagatgaataggagtgccactgttctcttgctgtgcgttgtctttccttctcactcaagcctgtgaaatctctctttcaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328258 - DNA, 1914 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328259 - DNA, 2401 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtaaaaaaaaaacaacaaaacaaaaacaacaaaaactttgtgtgcggcgcgcgcactctgggcccacgagaaaaaagcttttttgtatagaaccacactgtggttgtgggccgccgcgggggcaccccattgtggggttacgtggtagacaccgtgtgggtcaatacagcgtgtgtttccccctgggggagaacacccgtgggcacatagagacataaggcggggattggaggttctttctcccacccaataataaaaaaaaaaagcgcgccgcgggggggggagacccaccaccaaggaccgcttgtttctttgtgagaacacaacatttctccccaaaagagaggggagcagtctctaagagagagggggctacctatcatccgcggagcgatctctatctacacaccacggggagacgctctccaaaagcgcgagacctctcctcgaattatcttaacatattatccgcccccggttaccagttggg

SEQ ID NO: 328260 - DNA, 2311 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (56)..(56): n is a, c, g, or t
cctttttntcccccccccganaanangangnccccgnggttttttttttttttttntttttttttttttttaccaaaactagctttaatttgtccaaaagccacacagagttgtgtagaaactgatcctgggagggaagctgagagagtccatgatgcgcagggccaaggtgcctctagaagttctccagcaagcccaggatgcgcttttgctcgttctcccggaactccgggctccggccgtccccgatgttctctgcatactccttgatgatatgcctgacaattttgatggagcttcctcgcatgtttaggatctggtgaaccctctggcgaatctgggggacattggcattgcaggtctgggcgtgagtgcagggaagtggagtatttgctgggccgggtaccatggacgtgggcgaacttctgagctaccaggagggtcattgcgaggagcagtagagctgcactgccgaatgtcgtagccactagccacataggctgttgattgcttgaaatgtgactagtctgaattgagaaatactcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328261 - DNA, 1791 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccgcaaggagaggacagcgattctcgtacgaacggttacgattcga

SEQ ID NO: 328262 - DNA, 1680 bp, Homo sapiens
tgtgtggccattaatctatgacttagaacagggattgtagataagcttaatcggccacacccagcctgtgattgattcatagtctcttcttggaacactgtgttgagaaggattctgaggccagccatcttggctcagcagggaagagtgctgtggtgagtgagggattttgccatggagaaggagaaggacccatagcagtttgtcaggttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328263 - DNA, 1425 bp, Homo sapiens
  misc_feature (1129)..(1130): n is a, c, g, or t
  misc_feature (1139)..(1139): n is a, c, g, or t
  misc_feature (1141)..(1141): n is a, c, g, or t
  misc_feature (1206)..(1207): n is a, c, g, or t
  misc_feature (1395)..(1395): n is a, c, g, or t
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagnnctgaattgnanatttctttccaattgggccttttccaaaggggggaaaaaaaaaacgggaaaggatcgttcccggnngagcaacagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctgngcttcccttcctggcgggaaaacccccttg

SEQ ID NO: 328264 - DNA, 661 bp, Homo sapiens
ctccataatgtgtgcccactttcttgatcttcctgggagatttcataaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggta

SEQ ID NO: 328265 - DNA, 258 bp, Homo sapiens
catcttacattcccactatccatgtacaaaggttccaattactccacatcctcttcagcacttgttaatttttgtttttgtggagacagagtctaattctgtcacccaggctggagtgcagtggcgagatcttggctcactgcaacctccacctctcgggttcaagcaattctcctgtctcagcctcctgagtagctgggactacaggtgtgcaccaccatacctggctaacttttgtatttttagtagagatggggt

SEQ ID NO: 328266 - DNA, 458 bp, Homo sapiens
ttaatatgtgtgtatatacacacaaacattcataatgaaataaggagaaaatacttagaacaattacagttcttgtttctgtaactggtcacatggttattgctggtatttataacttatctattcaatttttttttcttgtttgccttctgcaagaacctcatgattctttacccagcagggtgacccaaaggtttggcccatttgtagttctgcctggattgcatttttgtagttatccattggccctaatcacaacgtggagtaatactgagaaacaccctaaggtatctcctgtactgtagacatactcttcaattcttccattgtggagtagtagttcagtttctccttgatagtccagatgaatcacctcagccaacaacaccacaactccctctttacctgttgactcagaggcacaaggagcccagagtagctgggtggcagtctttaaa

SEQ ID NO: 328267 - DNA, 1771 bp, Homo sapiens
acacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328268 - DNA, 1856 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328269 - DNA, 1826 bp, Homo sapiens
caaagtgctaggattacaggagtgagccactgcgcccggcctgctgcttcctcctcctcagggagacgccacagctctgcggcaagcaatccaccaggcaccagatccccagatacctgcccttcagggagaaatagcctgggatacagagaggcccagaggggagctctggctggacttggcttctcagcgtggggtctgggttcacaggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328270 - DNA, 1789 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagatccacctgcctgtgatacatctgccacgttagacatctatctctgatttaaccgactcccacataac

SEQ ID NO: 328271 - DNA, 1923 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328272 - DNA, 1814 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328273 - DNA, 2177 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328274 - DNA, 1878 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattccaaaacacaccaacacgcacacaaaaaccgggggacaaaaaagcgggccgacaacaccgcaccca

SEQ ID NO: 328275 - DNA, 2060 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggacccccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcc

SEQ ID NO: 328276 - DNA, 830 bp, Homo sapiens
acttgcaagggaagcttctttggatgtgacatgctgcagaacctgctcctgcaatttctgcagtaataattgcttgctctacgtccacggagatttctgcagtaataatcgcttgatctacgtctacggaatggcacagggcgtgtatcttactgtgagcccatgcattgccagatctccatcttgccactgatggcacaatgaacggtacatgccagcactgactggtttggaccaattgctagatctcctttgtaaatacccaacatcctgctctactttgaactgggttaccttggtgactgtacctatggtgtgtcctgaaggcagtgacctttcaccagtgtccacccagggcactcatgagtgccctgtcaatctctagcagtctcctagctgcttaccatgacggggcctgcctctgcctgaccactcccctcacccagagaaaccagcctggtacaggtagttcaaaaatagcaggaaggctgggtatggtggctcatgcctgtaatcccagcactttgggaggttgaggagggtggatcacctgaagtcaggagttcaggaccagcctggccaacatggggaaaccctgtctctacttaaaagataaaatttaaaaacatacaaaaaaaaaaaattagccagcgatgtggcatgagcctgtaatcccagctacttggaagcctgaggcaggagactcacttgaatctggggtacagacgttgcagtgagccaagatcccgccactacactccagcctgggcaacagagtgagactccatctcaaaaaaataaaatttaaaaagaccagactggtcaacata

SEQ ID NO: 328277 - DNA, 536 bp, Homo sapiens
ctgtatcctagtgggtgattagtaaaagttgattgaaccaaagggactgtggagagtttacaacctatttattttacttaaaacagttactcgaaggaggagataggtttgagtgtaggtttaacagggaaaaaatcttaggtgggaatccagtagagaggggagaaaatggtcagttatgaaaattagccgtcagccattttagtactaatgtcaggctgaaatatgaacaatattcattggaaattaacaataggacacaattctactcttgtttcagaggcggaagaggagatgcaagagatctgacagaaaaaactaaatgaaaccccagagggccagagagacttgacagaaatggcagataacaaacttggtttgggcttgaaatgtgatctagcagtcaaaggaaagccagtgctattctgggcagctaacaaagaagaattgtgccacggcatagggagttggcaagagcccaccgggagtattacatttagcacagtgtcagcatgataggatacagtagggagagt

SEQ ID NO: 328278 - DNA, 321 bp, Homo sapiens
tgcctcagtggcctaggttgtgaggatttgtggtggtgatgacacagcttcttcaggggtgggcttgctgaagtgtttctcaggctagggtgtatgcatgaacacagtggatcagccaacttgagggctggttcactaaggtttgtgccaccaggatgttttttggactttgggtgcaggtgctcaggatgagtcagctggcttggggactggctcaccggggtcagggtctctgggttattactccaactggagacatgagtcatgcctgtttggctggcttggagtgggtctgccagggttgggtctactcagctattt

SEQ ID NO: 328279 - DNA, 321 bp, Homo sapiens
acaggttcctcagaacttaaaaaaaaattttttttaaataacagtgtctggctctgtggcccacgctggagtgcagtataaagagcaaaagccttggtcactaggctcggccttctattttctcaccctcaaaaggggggatgataatcgtcggtcctacttacattaggtagataccaaataagagaatgagtatgaaatcacttcactaactataaagtactatccatataaacacggcatcctattacatggcttaaccaccttcaaggggagcttcatgggcatctggccaatgccggtggttaagacgggtaccga

SEQ ID NO: 328280 - DNA, 220 bp, Homo sapiens
aagaactcaaattaacaagctgaagttgtgtctagaggaactagaaaacaagaaccaactccaaagcaagaagaaaagatataactaaaaccagagcagaaatgaatgaaactgaaacccaaaaaaatccataccaaggatcaataaaaaaaggttggttatttgaaaggataaacaagatctataaattgatagctagatcaacaaagaaaaaagagag

SEQ ID NO: 328281 - DNA, 599 bp, Homo sapiens
ccaaactagtcctgaatgaatcattacctcgaaaggacgaatcaacatattaatgtgtgaaaaaccatcaaatttccatattaatagtgctttggaaatgaacacggtgtatgattataaacaaaacctaaaaatctaagacacgcaaatctaacggtctaagttttttaaactttgtgacattaacaacataaaaaactttttttaaatgtgggaaaaaatatcaaagaaaatttatagtgcccatcgccccaccagctagagataattactaataatctgatatatttagaggttattacctgttaattcagaaatactactttagatatgaagtcttttcaaccctgcttgatggctaaacagcacaaagtgatataaaggacagtctaacagcaatcctgaggaggctaaactcctatccacctgctgcctaacactgggcaggcttacatgcctgctccatcattctgatttcaaaaccactactgctccatcaggccagcatcacttcaacaaatacataaacatgcatctttctggtattagagattaagaacttgcctgctaaatactgcaatgcgcaatgccaggatagc

SEQ ID NO: 328282 - DNA, 358 bp, Homo sapiens
ggtgggtaaccaactggaaattatgggatcctagggacttttgagctttggttgagtgcttgcacgataagcaaagttttcttcttgtacagattgttacgctggagccttatctgtgacacccaaacatcagctcattgggtcaaaaatcacttgattacctgcaatagatattttgtctacagaaggccagacatcttgatggagtgagtcttttggctgggcctttctgtgtttgatagataaaagccccaccagctctgtctgaggttctaccaaactgatgtagcattctcttttctggactttgctgtgtctgtccagctactgcacaacgctatagctgcacactctcatg

SEQ ID NO: 328283 - DNA, 934 bp, Homo sapiens
aatgccaactcctcagaagcagctttctatgatcaccccagctggtctgtttgccatatttccttcatatttttaatcactatctgaaattaacatttgtgtttcccttcactctagaatgtaagcatcatgagaacagggctttgtcaagtttccattgccctcagtggtgaatgaatagactccctcaccttctctgtacctggtctggaattttgcctaacagcattaacatctaacttaatgacaaggaggaaggagattcttagaggcagtagaaaatggtcaagtgttcagaagatggcctttcattatatatctttagttctttctggcagatttggttatactgtcttaatctatcaggttgggtaagtagcccagggtgtcttctccattctttctgtatgccttatctcagcattaccatcttcctaggcttcaggataggaactcggtcatctttgacttcttttcttcaaagtcagtaagttatcaagtcctcctgattctacctttctgtgaatggtttcctgaattcatcccctgctgcttcagtcagaccctcacaatcctctgcctttagccatctgtttggtttctactttgtctcttctcaccttctcacctaaaaaaaaaaaaaactatagggctgggctcagtggctcacacctgtaatcccagcactttgggaggccaagacgggtggatcaccagaggtcaggagttcgagaccagcctggctaacgtggtgaaaccccgtctctgctaaaaatataaaattagctgggtgtggtcatgcgcgcctgtaaccccagccacttgggagtctgaggcaggagaatcgcttggaccggggaggcagattttgcagtgagccgagattgcaccattgcacttcagcctgggcaacagagcacgactctgtctcaaa

SEQ ID NO: 328284 - DNA, 171 bp, Homo sapiens
  misc_feature (96)..(96): n is a, c, g, or t
cgtctaagccaatcagatcccagaaaacagtaacaaaacccttcggaggcctttcagacgctgcatctctcggtttccttagccaacgcaccgtgntgggccaacgcaccgtcacccacggaatcgagaaagagctatcaatctgtcaatcctgtccgtacggtgcgttgg

SEQ ID NO: 328285 - DNA, 541 bp, Homo sapiens
cctctcccagcttccttgcctatgaaatgggggtctagaggcaactgaggtttaaccaaggtcatgcatacaaacagcttggctagggacgtagcagagtaagaattccataaaatgttaatatttttccactgaaaatgtctaccaagtgtatgaagttcgatttgcttctcagtacggactgggcttgaacatttccatctttttccccataaacgctctgaggagacaagccctgtgaacgtgcaccagctggaacacaccggtgcccttctggggctctggggatttcatcagattctcaaaagctgctgctgatacagatcatgttcttggccagtcgctgctcttaaacgcccatgaccttgcccccaaacatgagccactccaggcatgaagctgcaacccagagcccatcctgagaggccacgacctgtcagcacttctgagctgtcctagaggcgtaggcacttctggggctgactcggggacacagccatccccaggcacccagcgtgcagccaccacacgtggccaccaa

SEQ ID NO: 328286 - DNA, 541 bp, Homo sapiens
aacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaagaaaatgcccaagaaaagtgggaattaacctctggcaaaaaaatagtctaataagtggggctgtccttcctgtgtctgaaagcaaatacctgggccctgctctccctgatgcttttccactctactttgttttgtgtttcctggagaagccttctggatgccattctatgtgtgggggttgcaagtgctagttttgttctgtaagaaaaatgtgtacagaaaggaggagaaaacagactcactg

SEQ ID NO: 328287 - DNA, 184 bp, Homo sapiens
gagttctgtaaccggaaagaatctggttctcattctgggaaattaagagactactaatagtctcccaatgtctatttgctctcttaccttgggagcaaatccctgcttttttttttttttttttgagatggagtctcgccctgttgccaggctggagcgcaatggcacgaccttcgctcactgc

SEQ ID NO: 328288 - DNA, 262 bp, Homo sapiens
atgaagtagctatttattgtcttaattaagcaccggtattttgcattgagtttgcaattatatgcttttcttatctattcagttttaaaaccaagattttaagcaaaacacaaaagaaaaaacttcaagatgttggcttaatttctttctttgggtgactgtatatgttttaaaggaattaatggtgtttacttaaaagagattaaaattcagttatttattaatttagattgatctcactactgctttttcaaattaatga

SEQ ID NO: 328289 - DNA, 367 bp, Homo sapiens
atctgagtttgggatccctgattcagatgaggttctatcagagcatttaccaaaactttagttctcagaatactttacattttcatgtgccagttgcttcttgaaactttctcacatccccagacagaattaattaatatagcataattcaagtggtgacaaaagcatttaagcaaagtacaaggatgaagaatccaatatatcatcttagaatattaaaaaatgctttttttttttgagacagagcctcactctgttgccaaggctagggtatagtggtgcgacctcggctcactgcaatctccacttcccaggttcaagcgattctcctgcttcagtccctcgagtagctgggattacaggcatg

SEQ ID NO: 328290 - DNA, 81 bp, Homo sapiens
attataacacactactagatcttaatgtttataagcattatgctgtttgttcattcattcattcaacaaatagacattaaa

SEQ ID NO: 328291 - DNA, 2462 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcac

SEQ ID NO: 328292 - DNA, 2635 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcac

SEQ ID NO: 328293 - DNA, 2327 bp, Homo sapiens
tccgctcggaccaggctgctccaggagtaaggagcccagtctttgcatgcagtgttgaaaaagaggtcctcttcccctcgcagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcac

SEQ ID NO: 328294 - DNA, 1719 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcagcttactggacacgacttcctcctggcttctactccctcaacagctatcgttcttgctttatacgttgaatctctgtctctttataacttctaaatgttctcagcatcaggaaaatataaaaaataagttcacaaat

SEQ ID NO: 328295 - DNA, 988 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggctcatcagcagttgtgggctcatggccccatccgaggcggacaaggttggccgagagcacgggaggaagaccagagtccagttggcctggcatgacaggaggagcgacaacccgtctgtggccgagaaagcaagtcaaggcctatgccgaaaataagagagaagcacaagaaccgcggaaggaacgcacag

SEQ ID NO: 328296 - DNA, 445 bp, Homo sapiens
tttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggtgtgtgtccctgggcaaggggctgaacctctgtgtctcagtttccaccctgtgaggtggctatgaatcatggggttg

SEQ ID NO: 328297 - DNA, 2948 bp, Homo sapiens
aattctttcatttcagagttgagcaaactgtgtctcaaggaggtgtgcgctgcaggtagctgatgtggccaggatttgaacccacattttatattctttgccattagattccatttttcttatctcttatttctcagcgccaggtctctttttgtttctgggcctctttcttccttggcctcctgcctccctgtcttcccatgttcttgtatctgctgctgcctgtgtttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggagcccagtctttgcatgcagtgttgaaaaaggtaatgtccctcttgtgctgagcgagcacctggcacacagcagggacccaggcagtggggctgttaggttccttatctctcctgagccttgggcttccgctatccttgggacgtctggtcttctggcttccccggttcttcctgccgccctggatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcac

SEQ ID NO: 328298 - DNA, 2366 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcac

SEQ ID NO: 328299 - DNA, 2482 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagaggtcctcttcccctcgcagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcac

SEQ ID NO: 328300 - DNA, 1173 bp, Homo sapiens
gcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataagggatccgtcccggggattgactgcgggcttgcagatggaactcgaaggaaaccaacagggacactgggtgacaagaaagagtcgatcctcatggaccttgactgagtactcaagagccgcagatctggacacaacccgaaccctgaggggacctaaccaagacgatgccaaagcat

SEQ ID NO: 328301 - DNA, 852 bp, Homo sapiens
gactcttgcaccatgagaggattctattttatagcacctagaaagatggttttccaacctctatttatcctagtgccagggaatttcttctcataaatgatccattgatagctctcatgtttgaaaaggttatgccttttaaatcaaagtctataaccctttgatttctaccattttgtcttggttttgtcttctgaaacaaagtcctgtttaaaattgagaagtgttgtatgtgaagacactaatacaaggaacaccaatatttaaatgtttctccttacccttttttttttttggttagtgtttgaactttatggcttttctttctggaggacaagattgagaaaagtctttttattatttacattttagtaaacagtaaccatctagagttcgtcgagtggcaagaattttgaagtttggctgcccttgtgtactactggtagattttgtggaagttgctatttactgtttgtttcttatttatcagaaaatattgaggagatagcagccaatatgagctaattcagatttgtaaagtccttagtgtcctgaaatagttaacatatttcttaatctaaagcaagtctcccaatatacttaaagaagggtcctgaaatagttaacatatttcttaatctaaagcaagtcccccaggacacttaaagaagtgtagattaactttttaaatatgtttgaggacatgatgaagcatactaaatacatatttaaccaatgcctcccattttcactttctaataattttatgatagtttgtaattgttttgtttggaattagtgatgaatggaaatcacttaaaaaaacgttaacttgagaagtcatatctgctt

SEQ ID NO: 328302 - DNA, 400 bp, Homo sapiens
ttctcaggatgtgactactctactgccagaacacagatcaacccagaacatcctctcccaccaattttcactcctatccacttcccccaaaccagacacactttccttcttgtaatttctatattctttcttaatggtttctccagttttcaaggtaaggcttacttttttccttctttcaactttttttctaagtataacattaatgctaggggccaggcacggtggctcacatctgtaacaccagcactttgggaggccaaggcagttggatcacctgaggtcacgagttccagaccagcctggccaacgtggtgaaaccccgtctctactagaaatacaaaaattagctgggcatgatggtgggcaccagctattcgggaggctgaggcaggagaat

SEQ ID NO: 328303 - DNA, 281 bp, Homo sapiens
tatattggccaggctggtctcgaactgctgacctcgtaatccacctgccttggcctcccaaagtgctgggattacaggtataagccaccgcgcccagcctgtggtgcgtgtttcacagcaaccaggaggctgtcaagaaaattaatattaccttattgggtgccaaggcaacactgtttggtgttcagagctgattaaaaacaacaacaaaaaagatattataggaacaatatttagtgtgataaaatatacagtctaaaccaatagtcccttccttaatg

SEQ ID NO: 328304 - DNA, 614 bp, Homo sapiens
ggtattgctttgtttttcttcaaaaaaaaaatactaagccataattgtttttctcaaatattctggaaagtactcccaagaatctactgctttttcaaagccaactgaaaggtgttgacattgaatgtgcaatttttaaaaaatcaaaacttcaaatattacttcataactccactgattccttaaataccgattccttaaataccttaaataccgaccactgtgtttaactgcaaagccaaaaaattattttaactcctcaactagaaaagcatgtactgtcagtagtatcatgttaacaatgacttctgtacaggtacatgcaggaaatcaagacaatggtgactgcttacacatgccatcaaatcaactggtgaatgaaaaatgaaattaataaatagattttggcaattcaatactaaactactagcctcagggtttggctttttcctccatacttgagcatgtaaggaagtacaacctggttctttaaaaaaatgtgttgattaaattctcaataccccaacttcccaacctgtacaagaaaagaggcagctgcttccaacagtgttatcttacggccattaaataagttaataatattgggcaaaggg

SEQ ID NO: 328305 - DNA, 1004 bp, Homo sapiens
  misc_feature (901)..(901): n is a, c, g, or t
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctggggagtggttcccggagggatagaaccgacaaccggtagtggcggacctcgggtaggggnacctcatagtgtggtctttcccgtcgttgtctcgaccccaggtcaagaccccggtttgtgccccaccgaggggaaggattaaaacaccccgcgtggtttttct

SEQ ID NO: 328306 - DNA, 957 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaattaccttttaaccttccttcgctttcccagggtcggtctccctcccaatcatactttagtagaatggcgggaatggatttacggagggaagaggcgaaaacgtgtcgtgctgacacttggtaggggaaaccctctatgtgtgctttatcgactttggtctcgcctcagggctcaagaccctcgtttgggcgccactcaagaaaggggatagaaaaaacgtgg

SEQ ID NO: 328307 - DNA, 1157 bp, Homo sapiens
  misc_feature (1104)..(1106): n is a, c, g, or t
  misc_feature (1113)..(1113): n is a, c, g, or t
  misc_feature (1116)..(1117): n is a, c, g, or t
aacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggcacggcagccatttctactttgcccgcccacagatgtaaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaattcactcttacactctccttcccagggtctgtctcatcannnatcttantannctggcggaagggatacggaggatgagcagcaagtagtgcg

SEQ ID NO: 328308 - DNA, 1001 bp, Homo sapiens
gatataagaggctctcgtagtgtagatatgagattcagcacacgccacggcctatgtagacggtgttcggttgacgagtcagacgtttgtagagttcctaatgtattgtgtgtggctttgactgttatctgacttatgcaatcggagtgtcctctgggctctctatggtggtagttttcttatactgggtcgtgcagggctcgcgttatttgggatgtgcggtctttgttaattgtaaccctggtgtcaattgcttgttctctgtgtctacgaccgacgttggctctgcgtgatgtaatgtaagcccccttttagcttgtccatcgtagtcatggcctctgatgcgtgggtgggctctcccgagctcgtagttaacggctttgttgcggcgcatggcgcccagtagccgcagtacgaagtcgtcatgttgaagtcagccctagtgccatcattctacgattctgcattggctaatatagtggctcgctttaacctctccacccttatcacgacaccatagacacctcttgattactcctgccatcatgacccttggccataatatgatggtgatctccacactagcagagaccataccggacccccttcgaccttgccgaaggggatccgactatctcagcttcacatcgataccccaggcccctcgccctattcttcataccgaatacacaacattattatataacaccctcaccactacaatcttcctaggaacaacatatgacgcactctcccctgaactctacacaacatattttgtcaccaagaccctacttctaacctccctgttcttatgaattcgaacagggaggatagtcaggagcgtcaatgtgcttgtacatagagtgctgtagctgtgtgttccaataaattattttgtagggaaacacatatgacgcactctccccctgaactctacacacatattttggtcaccagaccctacttctaacctccctgttcgaattcataagaacagc

SEQ ID NO: 328309 - DNA, 1451 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328310 - DNA, 1481 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaaaaaaaccacacacaccacccacacacaaga

SEQ ID NO: 328311 - DNA, 1489 bp, Homo sapiens
  misc_feature (10)..(10): n is a, c, g, or t
  misc_feature (14)..(14): n is a, c, g, or t
  misc_feature (1471)..(1471): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaattccatctgccctccgggancctcagaacagctatgca

SEQ ID NO: 328312 - DNA, 1593 bp, Homo sapiens
  misc_feature (10)..(10): n is a, c, g, or t
  misc_feature (14)..(14): n is a, c, g, or t
  misc_feature (1457)..(1457): n is a, c, g, or t
  misc_feature (1459)..(1460): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaacaaccnannaacaacaaaagggggggctaaaataccagggccaatcccaccctttttaaagggccagaggctaaaaaaggcgggaaaacgggaaacctcggtcggaccccgtggtgcaccccacccgcaattggcgccgtcg

SEQ ID NO: 328313 - DNA, 1990 bp, Homo sapiens
  misc_feature (10)..(10): n is a, c, g, or t
  misc_feature (14)..(14): n is a, c, g, or t
  misc_feature (1558)..(1558): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaanaaaaaaaaaaaaaaaagaaaggagggggggcgcgggcgcagacaaattatctcgctcctacgcggcggcggccaaccacaatccccacgccccccccctctttttatctaaaggggaggcggcgccccacatgagtggggtcgctgtattatactagagaacggagcgcgggagggcggctgctaattaaatataaatcaacaatctattatcgagtgagagagagacacacaacccacgatccccgatgaggattgtaactcttatgtagaaagaaaacacccccctcctatctcttattgcgggggtgagagaacacacagcattgattgtgtaggatcattcacttcttttcactgtaagatatatattattatctggcggcaggctgagataaaacataaacactatcgagcaagacgcggcgaggtg

SEQ ID NO: 328314 - DNA, 1307 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggagtcaaggaagccagcatacctggaccttacactggggtcagatgagcccagc

SEQ ID NO: 328315 - DNA, 1307 bp, Homo sapiens
  misc_feature (10)..(10): n is a, c, g, or t
  misc_feature (14)..(14): n is a, c, g, or t
  misc_feature (1136)..(1136): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctgggcgcacagtaggggggaacgggttggangtgcaaatgggcacagaagggcagggtgctgaaaaaggggggaggcttgggggcaacggaaaacaggctaaagggcgtcggagaaaaaagaaagaggggaagacaagatagaaggttaggagggcatgaaagagacacgcttgctatagtggtattgtttatttattgtag

SEQ ID NO: 328316 - DNA, 1201 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctgcagaagggggacgggttaaccggaaagtggaaaaaaggccatgtcggggaaaagggggagccacggggggaagggaaaaagggaaaagggcgca

SEQ ID NO: 328317 - DNA, 1263 bp, Homo sapiens
aacattagggctaggtacgaggcctgggtggtgggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328318 - DNA, 1172 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgacagggtatcagaacagagacacagcatcgatactatgagtttctcattagcgctcggatcacccggaaattcctaatatgaacagttccttcgtacaggtgtagtctgagcgatggggccatcccaagcaggtacgcacttgcgatgagaaagacaaatagtgtagccactaaattgaaggcagagatgttacagaataagagcc

SEQ ID NO: 328319 - DNA, 1035 bp, Homo sapiens
  misc_feature (10)..(10): n is a, c, g, or t
  misc_feature (14)..(14): n is a, c, g, or t
  misc_feature (970)..(971): n is a, c, g, or t
  misc_feature (973)..(973): n is a, c, g, or t
  misc_feature (978)..(980): n is a, c, g, or t
  misc_feature (992)..(992): n is a, c, g, or t
  misc_feature (995)..(995): n is a, c, g, or t
  misc_feature (998)..(998): n is a, c, g, or t
  misc_feature (1003)..(1003): n is a, c, g, or t
  misc_feature (1006)..(1006): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgtcgtgtaagggggaaaacccttgatatagttgggttgttacccaagnntntgggnnncgaagccctacnggntcnaaggnccnccggtcctggtgcggccactagctcgggg

SEQ ID NO: 328320 - DNA, 1330 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggctgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328321 - DNA, 1533 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaagggtgagtgggccaccaccacatcgtcctggtgggatctagggttaggggcctcctacctttgtatctgactcacttggccccatcactcaaatgttttgcagaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328322 - DNA, 1114 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328323 - DNA, 1357 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328324 - DNA, 1058 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttccccttaaatctgcagacctcaccgactgcagcctgccagctctctcagggctcctcatctcggggtgaggtggggtgaggagacatgggtggacagggggagaagggccgctctgcctcttccaggcggaaccgcccttcctgtagatgaatgcatggcccactgacacatcctaggctgacacttgcctcttttccagcttttcctcagtcctccttttacctgggaatctttcctgggtgctcaaaaggggc

SEQ ID NO: 328325 - DNA, 794 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaggttaacaggggtcctgtgctccattcacaacattttttttatttaggtgggggggggg

SEQ ID NO: 328326 - DNA, 828 bp, Homo sapiens
  misc_feature (20)..(20): n is a, c, g, or t
  misc_feature (775)..(777): n is a, c, g, or t
  misc_feature (784)..(784): n is a, c, g, or t
  misc_feature (787)..(788): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaattcactcttacactctccttcccagggtctgtctcatcannnatcttantannctggcggaagggatacggaggatgagcagcaagtagtgcg

SEQ ID NO: 328327 - DNA, 1119 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328328 - DNA, 909 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagaacccgaccaggttgcccccttcaccttcttacaacctcttcccctttccccaggggtcctgtcctccactccagatcattcctttagtttagagctgaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328329 - DNA, 811 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328330 - DNA, 751 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttctatccgacccctcgtcggtttatctacctcgctacccctcactagcccctgctctccactcatcgctcccctaacttcttcattgttctccctactccgtcacgtacctaactgccttttcattcgcgccctcacttccctctcctcccccagcacatctaactcttccgctctccttccct

SEQ ID NO: 328331 - DNA, 484 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggactcgacgtatgcatttttgaataagctggggtatcacaagacggttaaaggcaggctaagggttcagcaccgaggaccttagtgagatctcggacaggtggttggccactggtgtattcactgatcaccatctgacgctatggac

SEQ ID NO: 328332 - DNA, 2353 bp, Homo sapiens
aacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggcacggcagccatttctactttgcccgcccacagatgtaaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328333 - DNA, 554 bp, Homo sapiens
gctgtcccctccagtccatccttagttaaaaggcagtaattggtatccctaaggagataggagccaggtccctgcttcggttgccatgacccccagggcaaaaggtgtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328334 - DNA, 1432 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328335 - DNA, 1445 bp, Homo sapiens
ccccgcggacgccaactaaggctaggtagcgaggcctgggtgtacacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328336 - DNA, 1424 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328337 - DNA, 1902 bp, Homo sapiens
  misc_feature (10)..(10): n is a, c, g, or t
  misc_feature (14)..(14): n is a, c, g, or t
  misc_feature (1470)..(1470): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaaaaaaaaaaaaaaagaaaanaaaaaaaaaaaaaaaagaaaggagggggggcgcgggcgcagacaaattatctcgctcctacgcggcggcggccaaccacaatccccacgccccccccctctttttatctaaaggggaggcggcgccccacatgagtggggtcgctgtattatactagagaacggagcgcgggagggcggctgctaattaaatataaatcaacaatctattatcgagtgagagagagacacacaacccacgatccccgatgaggattgtaactcttatgtagaaagaaaacacccccctcctatctcttattgcgggggtgagagaacacacagcattgattgtgtaggatcattcacttcttttcactgtaagatatatattattatctggcggcaggctgagataaaacataaacactatcgagcaagacgcggcgaggtg

SEQ ID NO: 328338 - DNA, 1545 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaacgacgccgggggtccaataaatcaccctgccgggacacacaaacaacaacaaaacaaacaatgggggggccgcccgaagaattaacacacctgg

SEQ ID NO: 328339 - DNA, 1350 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtttctcaccctttacttttgctgctaccatcttctctcca

SEQ ID NO: 328340 - DNA, 1192 bp, Homo sapiens
  misc_feature (10)..(10): n is a, c, g, or t
  misc_feature (14)..(14): n is a, c, g, or t
  misc_feature (1162)..(1162): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctacnttcgcgaggggatcctcatagagtcagccg

SEQ ID NO: 328341 - DNA, 1279 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctgagacccgggaaaaagggccgcacgagggcgaggctaaccggaaagggaacgagggcaagaccaaaagggaaaggtcgcgggacacgcgagaaaggaaaggggcgcgagacacacaaaaggagaggcacggcaggggggccgcgtaaagagcgccgcgggcgcggatagggga

SEQ ID NO: 328342 - DNA, 2032 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328343 - DNA, 1413 bp, Homo sapiens
aacattagggctaggtacgaggcctgggtggtggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328344 - DNA, 1161 bp, Homo sapiens
aacattagggctaggtacgaggcctgggtggtggtgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328345 - DNA, 1377 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaatccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328346 - DNA, 1056 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328347 - DNA, 967 bp, Homo sapiens
  misc_feature (10)..(10): n is a, c, g, or t
  misc_feature (14)..(14): n is a, c, g, or t
aaaaagaganaaantaaggctaggtacgaggctgggtgttgaatcggccgaggaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328348 - DNA, 1137 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaactcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 328349 - DNA, 794 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaacgcgtgaacgaaggcccgagccagcttgccacagagtccttgccggggaacctctagag

SEQ ID NO: 328350 - DNA, 668 bp, Homo sapiens
  misc_feature (20)..(20): n is a, c, g, or t
cggacgcgtgggtcgacccncgcgacaagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagctatgctttcctctccatgaatgccttcttcatctgcccagtttctccttcct

SEQ ID NO: 328351 - DNA, 752 bp, Homo sapiens
agataaagtctgactatgttgcccaggctgatatctcactcctgggctcaagctatctgcaaaccagagcctcccaaagtgctaggattacagggcatgaaaacaaaaagtaaaatgatggttggaaaaaaatgaagagtttgactataaaatacattattagaacatgaaaaacatctgtgaaatgtttagtagagtacattgttacttaaagattacttacatgtgtctcctgtctgaccaactgtaaataggtgtaaacttttcttctaaagagaagataatataaatctagtttatttgaagaatgatgtataatgaaacattattaaatttgagtggtacttaagatacaaatccaagttgagaaaaacactggtaagaatgctattgaataaactactgacaaaaagagtccctggaaaattcattatattcttgttcctatctttaagagaacagggcacttccttaagagcacaggaatcagttcttcagacaaatatattcagatactccttgtgttattctccactagttccttccagaaggttttacctgaaatctctagtcgacaatctttgctgaaaatataattaatctatctcccatatttctgaactctaaagatttttgttctgatccttttaatcatgccagaaattgtaaagttatttttccaccatcatgcaatgaacatggcatcagaaaattagttcctagtctcctgagcagtcactcttctgctttgc

SEQ ID NO: 328352 - DNA, 125 bp, Homo sapiens
ccatgaggtagaattctaatataaaacgttcttggtaaatgatatcctatatgactctgaagttgtgatgatgatgatgatggtgatttctttataaggaaaggacaactttgttaaaaagcccc

SEQ ID NO: 328353 - DNA, 1374 bp, Homo sapiens
tatttcatgaagagggcggccttcgttttatttactggaccctccggccgtcatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328354 - DNA, 1244 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328355 - DNA, 1607 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgacggtgagtcgggcctctgccctgccccgccacgcccgggcacctgggccggtgtttgtcaacaaagtcgggctgactggtcctgcacagctcagcgctcagccacgtttggcatgtcccgtgggcagccgggctggggcctcctcacccaggaagctattttgagcctgactgttttccccacacaggggccccgggagagggaggctccactaaaccccttcttttccctcaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328356 - DNA, 1772 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtgtgagtcagacccccttcccgggctgggcgcgggtgggacgggacctcccctccgctctggacgctttccgcacgcttgtcttgcatggagctgggacttccccaagtgccccccgctgtggatgcagagcttctctgccgttttgtggatcgggggctgccgtatcctgatgtatcgtctgcaaacacccctcccgccgtgggcctgtctccccctaccccatactttgaaccgtgtgccctcccctccccccaccgtcaccagcttgcagaggcaatcccctgcacccttgcagtttctcttttgctcttgcacgctccttttttgcaaactccccctgcacggtggcccctcccctgtccccggctgacccatccctaccctttggccccctcagggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328357 - DNA, 1450 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtgtgagtcagacccccttcccgggctgggcgcgggtgggacgggacctcccctccgctctggacgctttccgcacgcttgtcttgcatggagctgggacttccccaagtgccccccgctgtggatgcagagcttctctgccgttttgtggatcgggggctgccgtatcctgatgtatcgtctgcaaacacccctcccgccgtgggcctgtctccccctaccccatactttgaaccgtgtgccctcccctccccccaccgtcaccagcttgcagaggcaatcccctgcacccttgcagtttaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328358 - DNA, 108 bp, Homo sapiens
atctatatttttatttctactatgagggccttgtaataaatttctaaagcctctggttgcttgtatgttttcggcttctagaacaactaggacccctgccccctcccc

SEQ ID NO: 328359 - DNA, 1374 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328360 - DNA, 1320 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328361 - DNA, 1500 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagtaagtagccggggctgccgccgcctgaggtcagccgggacgggatgggtcgggttgggccgggccgggagcggaacgtagcacccggtggtccgcccgtcactgatccctctttcctggtctcaggatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328362 - DNA, 2005 bp, Homo sapiens
ctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtgtgagtcagacccccttcccgggctgggcgcgggtgggacgggacctcccctccgctctggacgctttccgcacgcttgtcttgcatggagctgggacttccccaagtgccccccgctgtggatgcagagcttctctgccgttttgtggatcgggggctgccgtatcctgatgtatcgtctgcaaacacccctcccgccgtgggcctgtctccccctaccccatactttgaaccgtgtgccctcccctccccccaccgtcaccagcttgcagaggcaatcccctgcacccttgcagtttctcttttgctcttgcacgctccttttttgcaaactccccctgcacggtggcccctcccctgtccccggctgacccatccctaccctttggccccctcagggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgacggtgagtcgggcctctgccctgccccgccacgcccgggcacctgggccggtgtttgtcaacaaagtcgggctgactggtcctgcacagctcagcgctcagccacgtttggcatgtcccgtgggcagccgggctggggcctcctcacccaggaagctattttgagcctgactgttttccccacacaggggccccgggagagggaggctccactaaaccccttcttttccctcaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328363 - DNA, 1002 bp, Homo sapiens
gaaatttttccgagggcctcggtacctcggacgccgggattcctgggccggtgtttgtcaacaaagtcgggctgactggtcctgcacagctcagcgctcagccacgtttggcatgtcccgtgggcagccgggctggggcctcctcacccaggaagctattttgagcctgactgttttccccacacaggggccccgggagagggaggctccactaaaccccttcttttccctcaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctc

SEQ ID NO: 328364 - DNA, 674 bp, Homo sapiens
ggatggaaaggtgcaaaaatctatcaccagcaacagaaggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcga

SEQ ID NO: 328365 - DNA, 908 bp, Homo sapiens
ctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaacgaagaataaataaataatataaaaataaaataaatact

SEQ ID NO: 328366 - DNA, 778 bp, Homo sapiens
  misc_feature (613)..(613): n is a, c, g, or t
  misc_feature (621)..(621): n is a, c, g, or t
  misc_feature (679)..(679): n is a, c, g, or t
ctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctgagtagctgggattacaggtgtgtgccagcatgtctggctaattttngtattttnagtagagacagggtttcaccatgttggtcaggctggtcttgaattcctgacctcgtgntctgcccgcctcagcctcccagagtgctgggattacaggtgtgagccaccgtgcccggctcacctcttctttttttttttggaaccggggtttggccct

SEQ ID NO: 328367 - DNA, 814 bp, Homo sapiens
ctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcga

SEQ ID NO: 328368 - DNA, 767 bp, Homo sapiens
ctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccacccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcga

SEQ ID NO: 328369 - DNA, 1407 bp, Homo sapiens
aaccctctcccagttcccctgcagctcttcaggaacccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagtcctgagaatcagagacagaacataaaaggcctggaaaacattctccaaaaagaagctgcaacatgtgtggacaatgggcttttcatgcctctcttactgtctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatatcatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcg

SEQ ID NO: 328370 - DNA, 1885 bp, Homo sapiens
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtg

SEQ ID NO: 328371 - DNA, 1727 bp, Homo sapiens
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtacta

SEQ ID NO: 328372 - DNA, 605 bp, Homo sapiens
tcttcctcctctgccgtctccttccttctgctcctctccttcttccttctccttttcttcttccttctccttctttcttcctccttcgtcttagtgcttcggctgccttctccagacaaagggtctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtacta

SEQ ID NO: 328373 - DNA, 1256 bp, Homo sapiens
tcttactgagttttctagagcaaagctgctcatccctgcttgcatgtctttagtattgagggtaaaggccttagtgccctggaaggtgaactttagaggttgttaaagggtcatggaaaaaagaggaggtggggtcttggattgtggttgcagagcgctataaactgaccgtaacagatggtattcttttaaacaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtacta

SEQ ID NO: 328374 - DNA, 181 bp, Homo sapiens
gggcctggcagaggtcttccaggtaggggtgtggcctctctgggcacccgtctatttgcctgtgtcccagcggagggttcttttggcaggatggggaaagggtcaggaacccattaacaggtggggaaacaatgtcatcactctggggccaacctagggattagaatcaaggtctcccagg

SEQ ID NO: 328375 - DNA, 91 bp, Homo sapiens
cagcagctcttgccgtaggatctgttcattgagctcatcctgttcttcattctcttcttccccggattccgtcgatggatccctggggaat

SEQ ID NO: 328376 - DNA, 514 bp, Homo sapiens
tgcccagaggagtgattatgtcatggtcgtggtcttcagacaggagcgggtaaaaaaggggtcttaggggttgacaggtaggcagcatctggacatcttcctaaggaaaacagcagggaaatggacacagtcctctcagaataaatgtgaacttctaaccatttcacacccgttaaaatggctattaacaaaacacagaaagtaacaagtgtcagtgaggatgtggagaaagtggagaccttgtggactgtcggtgaaaatgtaaaatgggtgcagctgcggtggaaatggtaaggtggttcctaaaaaaatgatgggaattaccatctggcctagtaattgtactgggtatatgcaaacaaacaaacaaacaaacaaaaactgaaagcagaatcttgaagagctatctgcacacccatgttcacagcagcataattcacaacagccaaaaggtggagacgagccaagtgcccattgatggatgaaggcacaaacaaaatgtggtccacccaca

SEQ ID NO: 328377 - DNA, 197 bp, Homo sapiens
ttgtgcatccagcataactatctaattccagaacaatgtcatcatccccaaaagaaaccccatacccattagtaggcacttaccattctcctgtcctcccattctctaaaaactattaatccacttcttgtctctgtggatttacttattcttgatatttcataaaagtggaatcatacaatatatgttcttttgtt

SEQ ID NO: 328378 - DNA, 571 bp, Homo sapiens
ccattatttagaatgggatttgtttagggtcagaaacactttcccaggtgataaataactgacttttccatcagttcttatttaatagatgccttaatgggatatatttggggtgggagaaggcataattgtaacctttttgagggaaaggtagccgacgcatctgacctcataaatacttgtttaattgaatgggaaagatgatcaaaggattctaaagtatggtaaagacggccctagcaatatactaatgtatacattgtactgaagcgtatgtattaaagccataatacgatgtgatgtttgaattagcagaacattggaagatgaaagttgtaattgaggaaggaataagccataaagttactttttttttttcttttttttttttttgagatggaattttgctcttgttgcccaggctggagcgcagtggcgtgatcttggctcactgcaacctccacctcccaagttcaagtgagtctcctgcctcagcctcccaagtagctgggattacaggcaccctccaccatgcccagctaattttttgtatttttagtagagatgaggt

SEQ ID NO: 328379 - DNA, 3097 bp, Homo sapiens
agcggcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttatattaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcatttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaaaaaaaaaa

SEQ ID NO: 328380 - DNA, 2876 bp, Homo sapiens
attctttggggaggcaactaggatggtgtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttatattaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcatttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaaaaaaaaaa

SEQ ID NO: 328381 - DNA, 2905 bp, Homo sapiens
agcggcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttatattaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcatttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaaaaaaaaaa

SEQ ID NO: 328382 - DNA, 1825 bp, Homo sapiens
agcggcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatcccctggtatctagccaggcccatgattaccaacatcgagacatccggtacactt

SEQ ID NO: 328383 - DNA, 1587 bp, Homo sapiens
ccatgacgcagcttgcaattcgatcgaatttctttgcctatcatgtggcacaaatcagcctcaccatctgtttgcaaaaggaagccttagtttaaataactttgttgtagtttaaataactttgttgttcttgcctttttccagagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttatattaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcatttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaaaaaaaaaa

SEQ ID NO: 328384 - DNA, 396 bp, Homo sapiens
taaactcctgacctcaggtgatctgcctgcctcggactcccaaagtgctaggattacaggtgtgagccaccgtgcccggctagtcccaggttttcattcaacggccagggaataacaaactgctcctttccccaaggtgtggcaccctccgtggaagcctttgacaagctgatggacagtatggtggccgagtttttaaagaacagtaggatccttgctggggacgtggagacccatgtaagtactttcctcccctgttctcagtagagagtttaaacttaccagcccagcctctgacaacgctaacagcctgaggagatctttatttatttatttagtttttactctggctaggcagatggtggctaaaacattcatttacccatttattcattt

SEQ ID NO: 328385 - DNA, 3019 bp, Homo sapiens
agcggcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccataatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttatattaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcatttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaaaaaaaaaa

SEQ ID NO: 328386 - DNA, 2559 bp, Homo sapiens
agcggcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtgtatcattcagtctttttaccgatcagttactgtgttcatgacatgaggggcacagaattcttttttttttccctttaaatccctaatgttcacaagtcatcatgtggaactaaaatcacacacaaaggcaaatcatgaggaaacgttaaatatttcaaaatgcccacgaggcgtgccagattacagtgctgtatctatagcacagaatcgttggagcccttaagctaaagcagtaggggctactgcaacttctagttcgtgaactgctgctttttttctttgtttgatagtagggggattcagtgtagtggggttcggtctctcaggaagttagccataatttctccaggttcagtgattaacttggatccatcccatcctgtcatgaacgtca

SEQ ID NO: 328387 - DNA, 1387 bp, Homo sapiens
agcggcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccagaggacaggattaccttgtgattcagagacttgctgaacagtgcttcatttcaatcgaaatcactttcagtta

SEQ ID NO: 328388 - DNA, 310 bp, Homo sapiens
tggctcatacctgtaatcccagcattttgggaggctgaggtgggaggatcgctggatcccaggagtttaaggtcacagtgagctatgattgcaccactgcactgcagcctgggcgacagtctaagaccctgtctcaaaaattaaaaggacgaggcagtagcccgattggcgtgaggatgtccaggttctgtttggaggagaagaggttggcagccagagaacaggaggcagtggggacaggccacgcgggagaggacaaagccatggctgtggggacaaagggggtgaggacagcacccaagggtctgac

SEQ ID NO: 328389 - DNA, 552 bp, Homo sapiens
tggctcatacctgtaatcccagcattttgggaggctgaggtgggaggatcgctggatcccaggagtttaaggtcacagtgagctatgattgcaccactgcactgcagcctgggcgacagtctaagaccctgtctcaaaaattaaaaggacgaggcagtagcccgattggcgtgaggatgtccaggttctgtttggaggagaagagggaacggtagaacctgtcaagggagggatgaagtctggggtgagtggaacagggacaggagaagcagagagggcagccgagagcatccagtcggattgtgctctgaagggggtgctgtagggcattgaggagcatggaggaagcagagacctggcctgcaggatcaggggaggctttctgtgcttattccacaagcaggtcctgtcagaggtgtaggaatgtcccagacaaattggggagaggttggcagccagagaacaggaggcagtggggacaggccacgcgggagaggacaaagccatggctgtggggacaaagggggtgaggacagcacccaagggtctgac

SEQ ID NO: 328390 - DNA, 412 bp, Homo sapiens
  misc_feature (9)..(9): n is a, c, g, or t
  misc_feature (27)..(27): n is a, c, g, or t
  misc_feature (51)..(51): n is a, c, g, or t
  misc_feature (79)..(79): n is a, c, g, or t
tcccggccncgtatgttgtgtggaaantgtgaaacggataacaatttccanacaggaaacagcctatgacccatgattnacgcccaagcttggcacgaggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgt

SEQ ID NO: 328391 - DNA, 2370 bp, Homo sapiens
cggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgt

SEQ ID NO: 328392 - DNA, 899 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaagtaagtcatgttggcaataatgtgattttgcatgttttttttcatggcccagaaatttccaacttgtatgtgttccattcttatctttggtatctacacccattaagcaaggtatgaaattgcagaaatgcatatatgtataactgtatatttacacacatttagctaaaggcaaatacaataaacttacaataggcgtcatctca

SEQ ID NO: 328393 - DNA, 508 bp, Homo sapiens
gtccatgaccttgggcacaggggaaggcagtgaatttctactttatgcatattttagggagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgt

SEQ ID NO: 328394 - DNA, 487 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagcaatttaaggggggcccctttttttaaaatttttgtggggccaaaaaattttttttttttttttaaatgcagaagctataaagaag

SEQ ID NO: 328395 - DNA, 372 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaagttattgtagtctgatatgtcctgatcacatctgtggcggtactgtggcgccccaatgttatcgcctagcatatcatctccggcatggcgatttactacattcagttgat

SEQ ID NO: 328396 - DNA, 241 bp, Homo sapiens
  misc_feature (5)..(5): n is a, c, g, or t
  misc_feature (73)..(73): n is a, c, g, or t
aaagntttatcccatggaactcaaatgtattcaagtagtcagaacgttgcacatttgggaacctttaatgaanagcaagtccttggtcatgaagccagcctcaattgtcacaataaagagcttgccttctttgcaaatgctttggaagaagtctctattgagacaattgaggctggcttcatgaccaaggacttggctgcttgcattaaaggtttacccaagtaagtataagatgccctag

SEQ ID NO: 328397 - DNA, 2428 bp, Homo sapiens
cgttgaccttctgctctgcctccttcagcaaaccctaccaacatgcactaccacaaccggcagaatgactcctgtctaaaggaaatatggggacaaagagtagatcagagactgaaggaaaggccacctagaaaacgatctaccactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328398 - DNA, 2320 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328399 - DNA, 2316 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328400 - DNA, 2319 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaagataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328401 - DNA, 2402 bp, Homo sapiens
cggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328402 - DNA, 2473 bp, Homo sapiens
cggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggtactaaaaacagctaaattctcctgtgagtgttctgtatgttaacacttttattccttgttttgttttaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328403 - DNA, 2614 bp, Homo sapiens
cctatagtccctggcactcaggaggctaaagcatgagaatttcttgagcctgggaagcggaggttgcagtgagctgagatcacgccactatactccagcctgggcaacagagcaagactcttgtctcaacaacaacaaagaaaaagtgtttttgtttactgcttagcttacacacaaatcaattgagcaaagaaccctaggggctgtttacagaaattccaggagaagtttcatgcatggggtaagggccaaatcaacagaaacacagcgcctggtttcctcagcaccaagttgcccttcagtttcagttgcccttggtagctgtatgaacttgaatctccccagatgaatgtttgttaactttaattatgtttgtttttcccaagaagtactactttttctgtctcttatcagtgttaaacatctcctctcagtttgaaaatcagtagatcaacctggttaaagataactttttgccagataaatgagttacacaactctccttaccatccttctgtttctctacatcctcacaatcatttgtactgaatgcaacagaggaaggagtgttattgctttgtgatgactccgtggttgattattaacttcacaggtgatgttgggaggtagcaaaaatggagaaaagaagaaaatcaattatatagatataagagttgtaatgtggttctttcaataagaaaccacagaagagaactgttgtactgagggtatgaaagagagcgaggaagggcaactgggatgttcttagatccaaccgatcctgtgtttacctgccttctcttcccagtcccagcaagtgtatgagcagcttgagggttcttaagagacagctctcgtccatctttatttccccagaacagcagagcattgcacataagaataacaataatagattgagctctgtgtccagtactattctaaggaatataaatatatattcatatatatttatgaatatatgtatatttatctaatcccacagcaacctagtgaagtaggtgctgttattactcccattttacagataagaaaactgagccgcagtagctatgaagtcatagaactagagtggaatgtaggcagttggaccctgaaccctccatcaaggagtaggtatccctgaaataagtgaggggaaaatgcagcctttccagacccattggctctgatatctggagcggggatcctgccttctgaaaggcagaattattggtgattccatgtgctcttgtttactttgcttaccaagacctatcaagattgagtcatttatgctctcatctctgagagactcagtgctcttcatgcagttggacccaacgcttcatgctccactacttacagggtaggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328404 - DNA, 1443 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgt

SEQ ID NO: 328405 - DNA, 740 bp, Homo sapiens
  misc_feature (26)..(26): n is a, c, g, or t
  misc_feature (34)..(34): n is a, c, g, or t
  misc_feature (54)..(54): n is a, c, g, or t
gcctataaaatatcttttcctaatanacgtatcnattcctggataaatgttccntatcaacaacagttatataaattttcagaaagtacccactttgtcagagagtccacttaaaaggaacctgtcggaagtatgtagtcgactacatacttccgcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328406 - DNA, 475 bp, Homo sapiens
gtactgggttggtaactccacctcaacgcctgctatgatggataagatagagagagtgaggagaaggcttacgtatagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328407 - DNA, 706 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagggtaaatgagttacccctccgtgtagcaaactcagaaaggataatctggctgggcatggtggtgcacacgtgaagtcccagctacttaggaggcagaggcaggaggatccctcaagaccaggctggagtgcagtggtgtgatcttggctcactgcaacctctgcctcccgggttcaagcaattctcctgcctcagctacttggaaggctgaggcctgaggatcccttaagcctaggagttcaaggttacagctatgagctatgatcacaccactgcctacgcaacagagcaagaccctgtctcga

SEQ ID NO: 328408 - DNA, 379 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagcaggcgttatgagctaccgttataggtgtgcttgatacctgctcctttgatctttgatctaggg

SEQ ID NO: 328409 - DNA, 433 bp, Homo sapiens
ctgtccttccaaaacaagttagaatgtccttatctagaactggcttttctctcattatgtgcctcagaaatttgttggaaacctgtctgggacttctgaaatctagtctcagatgtgagagctgagaagtaggtcatttggttgtggtgggtgattttagccttattacaactacattacatttattcttctcccttttttcctctcactggcttctcctctacagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaaagtaactatagttcttttttaactttttc

SEQ ID NO: 328410 - DNA, 2374 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328411 - DNA, 2731 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccaaaaaaaaaaaaaaaaaaaaaaaaaaatttggggggggctgggcggggaaagggtttttaaaaccctttggtggggggggggggccatgggttagtgcacacattgcccaaagcgcggctccagaggaaacctgtgggcctgaactaaggtggtgggttttttccacccaaataaaaaaacggcgtgggaacacggggtgtttttggaacaactcacgagtggggtgtcgggggcatgacccggtcttatcaaaggggtccaaggagtgccagttctacgcgcccccgcgtggtggggggcacgtacagaagaaacgcaaccccaggaaacagaaaatacaacagaaagagggaccag

SEQ ID NO: 328412 - DNA, 687 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtttttgttgttcctgggccttgggtagagatcctc

SEQ ID NO: 328413 - DNA, 2332 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328414 - DNA, 2342 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgt

SEQ ID NO: 328415 - DNA, 2222 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaaggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328416 - DNA, 2320 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328417 - DNA, 2320 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctgcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328418 - DNA, 2320 bp, Homo sapiens
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328419 - DNA, 2445 bp, Homo sapiens
  misc_feature (308)..(309): n is a, c, g, or t
  misc_feature (354)..(354): n is a, c, g, or t
  misc_feature (366)..(366): n is a, c, g, or t
  misc_feature (368)..(369): n is a, c, g, or t
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaagttattgaagtcaaaatgtccaaaagaaatcagctgtgcggttctnngtggtacgagcactgcaacggacgacttgaaacactgggaccgancggacacttcantnnttgggggaactttgactttacaacgaagcaaacacccttcgaaattctcgttctgttccgccgccgttaaccggatggggcaaactctgggcatcctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328420 - DNA, 2118 bp, Homo sapiens
gtcccagactcttaaacaaccagatttcaagtgaattaactgagcgagaactcacgtaatcaccaaaggggatggtcctaagccattcataagggatccaaccccatgttccaatctcctcccactgggccccacctccaacactgggaatcacatttcaacatgagatttggaagggacaaatatccaaaccatatcagtatgtaaaagaagtttcaaaattatttgccttttcttaaatgtatttctggttcatatcagtttttggcatttctgcatcttcaggattttaaagactgtatgttttttcatttctgctgtccttccaaaacaagttagaatgtccttatctagaactggcttttctctcattatgtgcctcagaaatttgttggaaacctgtctgggacttctgaaatctagtctcagatgtgagagctgagaagtaggtcatttggttgtggtgggtgattttagccttattacaactacattacatttattcttctcccttttttcctctcactggcttctcctctacagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacca

SEQ ID NO: 328421 - DNA, 1086 bp, Homo sapiens
  misc_feature (705)..(705): n is a, c, g, or t
  misc_feature (710)..(710): n is a, c, g, or t
  misc_feature (713)..(713): n is a, c, g, or t
  misc_feature (718)..(718): n is a, c, g, or t
cctgggaggggacaaagcgggggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcctgntttgntgntcctnggcctggaaaaaaaaaaaaaaaaaaaaaaaaaaaaaatttggggggggctgggcggggaaagggtttttaaaaccctttggtggggggggggggccatgggttagtgcacacattgcccaaagcgcggctccagaggaaacctgtgggcctgaactaaggtggtgggttttttccacccaaataaaaaaacggcgtgggaacacggggtgtttttggaacaactcacgagtggggtgtcgggggcatgacccggtcttatcaaaggggtccaaggagtgccagttctacgcgcccccgcgtggtggggggcacgtacagaagaaacgcaaccccaggaaacagaaaatacaacagaaagagggaccag

SEQ ID NO: 328422 - DNA, 250 bp, Homo sapiens
gggctttgggagccagggacagtttatctgatatcacaggagagagagcaccctgaggtgggcattggctgtggctggagcctgtgaatggagaggagtggaacagtaggagcccggacgggcaggcgagatcaggtcctggagactttgattggatcttaggtgactgtcaagagtagttggaagccgctgatggatttgaagcttggcagtatcatagtcggcactcttctgtaaaaggaaccgtatg

SEQ ID NO: 328423 - DNA, 173 bp, Homo sapiens
aaatgtgaggacagagaaagaataagcggccagtggcatcactgagacccatctgcccagtcttctgtccagaagtctgtgcaagaaaacatgtagctattgcctaaatgtacagataggctttccagtgcatatatcttttggtgttttgaatttggtgaaggtagatctat

SEQ ID NO: 328424 - DNA, 450 bp, Homo sapiens
acctgggacttgggggctcaatcacgggtggccatcagctaccctgggcagggaggtggtcagaggcagctgtgaagtacaagctcctggaaaatggcagacctggaggcctcattgagctttgagctcaccctaagctcaccctaaattggagaattccttctggaatgttggtgccattccctctatccaggagggaagatgatggtgggaccactcctaaggacattcctctcaactggcctccctcctttccaccgcctctgtcaccccatcacctccgctcagtgtcaccccaggccggctccaggcatgcctagcatctgagacgtgcccagctcactcacagacaaggcactcataccccccagggctccagttccagccccagtcacccattcatagcctcagcccccttctcttatgccaaggattgcctgtggacctcca

SEQ ID NO: 328425 - DNA, 649 bp, Homo sapiens
ttcactcactcctctaatacagagcacctcctatatgcaaggcgcctgtgcaggcacctaggaggctgcaaagatgaacaaagatggtctctgcccagacaccaagtccttattggaaaatagaactcccaattactgcctttcccccttttgacagagcaatgaagtgcagcattgcctgtatcatcctttccctgtgccccgtcgcattactggaattaatacatgttcagtaaatattctttgaatgatagggtttttcttattttgaacagctttaatgaggtataatttatgctccataaaattcacccattttaagggtacgactgaatgattttgggtaaatttaccaagttgttgccactcttgccataatccagttttagaatgttttcatcattttgtaggttgaaaccgcaggcctattcatttctttcttccttcctctctctcctgtaagtgttgattgagcatccaccctgtcctagaccctgcttggtgctagggacataccagtgagcagggtggatgaggtcctcacccgtgagctcatatgctgatgggggagacctacagcaagcaaggagataaataaatacatcatttacctctatttgatggtcgacgcgggccgctaatttaatag

SEQ ID NO: 328426 - DNA, 1694 bp, Homo sapiens
  misc_feature (1614)..(1614): n is a, c, g, or t
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaaaaaaaaaaaaaaaaaaaaaaaaaaaaaaaaaaaaaaaaaaactcaggggggccccgtcccaattgcctatgagggcngttacaattaatgccgtgtttacacttggactggaaacctgggttccatttaaagctttgagaattcctttttcagttgc

SEQ ID NO: 328427 - DNA, 1647 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaaccacaaaaaaaaaaccgcgggtttttgtggggggggaaaaaaggtaagggcatggtcatagttcgaccgtttgaaaggggaagcgggcccaaggggaatcgactcgaacc

SEQ ID NO: 328428 - DNA, 1527 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaacacttttatttctggaagtcagaagaaaaacaatgtgcacaacctgaatgacacagagcggcagcgctgaaaccacaggggctgccgagagctggcctttcacagcagaccactgttttccagtgagaatggtgggccattccaaaacaaagctaaagggttcc

SEQ ID NO: 328429 - DNA, 1282 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcgtttttcgctctggaatgagccacatacaactttaaggtcttcgcttggccttgttttaccctcaggaatcagctatgcg

SEQ ID NO: 328430 - DNA, 1503 bp, Homo sapiens
aaactgattactagtgcgatcccggctttatttcagtcacgaggccggcttccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328431 - DNA, 998 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactgtaagtgcatctgtgtggggg

SEQ ID NO: 328432 - DNA, 1444 bp, Homo sapiens
gaggataaaactaggtccaaagagacgtccgcgttcgccagggttgtgtcggggggcgaaaagagcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328433 - DNA, 1557 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatgtaatgcagttttcaatcaaaggccaagcatctctattttgaatgtagatcagcactaaaagccctgttttaatagcatttatactaattcctaccagtcctcacgaggagggtgacacacaccctgttcccacttgagagagggcatctgcaggggtggaggggagaccccatggctcggcctggtgccacagcctgcgggcctgccgcccaccagtgctctgcggtcccactgtggtccccgagtcccctcagctgtttaaacttgggaggctggtgagggcctcctggcagagcgtcctccatccctctgtcacgtacctttctgttctctgatgaggtttttgtgtcctatcgttttcttccacattggaagcaatttctaatatccctcatcacttcaatctatttaacgcaaatcgtgcctctccccctttttcttacttaccaattctagaacagtagagcagtgatatccacacacatccatttactctttgtagttttcattggatcttaattaggtggcctcgaagcaacgccttttgaagtgaccctgtggccgttggtagctctgttggcggcttgatggaggatcctgagatgaaacaaagaccgtctttgccctgtggcgagttctttgttttttttttttgagacagagtctcgctctgtcacccaggctggagtgcagtggcacgatctcggctcactgcaagctccgcctcccgggttcacgccattctcctgcctcagcctcccaagtagctgggactacaggcgcacgccaccatgcccggc

SEQ ID NO: 328434 - DNA, 977 bp, Homo sapiens
  misc_feature (19)..(19): n is a, c, g, or t
ctaggctaggtacgaggcngggtggtttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328435 - DNA, 1286 bp, Homo sapiens
  misc_feature (1232)..(1232): n is a, c, g, or t
  misc_feature (1253)..(1253): n is a, c, g, or t
  misc_feature (1278)..(1279): n is a, c, g, or t
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatgtaatgcagttttcaatcaaaggccaagcatctctattttgaatgtagatcagcactaaaagccctgttttaatagcatttatactaattcctaccagtcctcacgaggagggtgacacacaccctgttcccacttgagagagggcatctgcaggggtggaggggagaccccatggctcggcctggtgccacagcctgcgggcctgccgcccaccagtgctctgcggtcccactgtggtccccgagtcccctcagctgtttaaacttgggaggctggtgagggcctcctggcagagcgtcctccatccctctgtcacgtacctttctgttctctgatgaggtttttgtgtcctatcgttttcttccacattggaagcaatttcttttgcaagtttgccttttccagtacatatattggccatctacatgttatcactctcgctgcgttcggtcagtctttggctgtgctttatccncccaagtaggaacatgccacnattccagtagacacagctgtgcacnngggtacc

SEQ ID NO: 328436 - DNA, 1081 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328437 - DNA, 2029 bp, Homo sapiens
ttcactcactcctctaatacagagcacctcctatatgcaaggcgcctgtgcaggcacctaggaggctgcaaagatgaacaaagatggtctctgcccagacaccaagtccttattggaaaatagaactcccaattactgcctttcccccttttgacagagcaatgaagtgcagcattgcctgtatcatcctttccctgtgccccgtcgcattactggaattaatacatgttcagtaaatattctttgaatgatagggtttttcttattttgaacagctttaatgaggtataatttatgctccataaaattcacccattttaagggtacgactgaatgattttgggtaaatttaccaagttgttgccactcttgccataatccagttttagaatgttttcatcattttgtaggttgaaaccgcaggcctattcatttctttcttccttcctctctctcctgtaagtgttgattgagcatccaccctgtcctagaccctgcttggtgctagggacataccagtgagcagggtggatgaggtcctcacccgtgagctcatatgctgatgggggagacctacagcaagcaaggagataaataaatacatcaaatagaggtaaatgatgtgaagaaaacaaaacgggctgagaagatagtgtgagactgtaaggagttttaaattttaaaacttgctactcataattagatattcaagtttctgaaattcgcatagtgcatttcagatgatgagagaggtgacagccgtagaaagtgggagaagtggttgcggggagatgggtgagcgatggaggtggcgagcaagttggagagatgcagggagagtcaggtgacaagaagagagtgtgctgaggacagatggcggacagacaggccgctgcccccaatttttggtgctctttcattcctgcactcaggcacgaggcagacaggaaagacaggcagtgctgcttcgtaacaggcatctttcttgccctaagtatacatcttagaatgtgtggagaaagtcacgctatgggagcacttgggcaggctcaggtgttcactgtagtagaaggagaatgactctagctgatgttgggaccctttgctgtcaccccgcagtccccacagtgcccggtgtgagttgtaagaaaatggtggtcagtgattgtcttcgcattttatatacgcacaggtcaaagagaatgaactctaaatgtttcccagtttgatttttctgcttctgtttagccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328438 - DNA, 2186 bp, Homo sapiens
  misc_feature (2106)..(2106): n is a, c, g, or t
ttcactcactcctctaatacagagcacctcctatatgcaaggcgcctgtgcaggcacctaggaggctgcaaagatgaacaaagatggtctctgcccagacaccaagtccttattggaaaatagaactcccaattactgcctttcccccttttgacagagcaatgaagtgcagcattgcctgtatcatcctttccctgtgccccgtcgcattactggaattaatacatgttcagtaaatattctttgaatgatagggtttttcttattttgaacagctttaatgaggtataatttatgctccataaaattcacccattttaagggtacgactgaatgattttgggtaaatttaccaagttgttgccactcttgccataatccagttttagaatgttttcatcattttgtaggttgaaaccgcaggcctattcatttctttcttccttcctctctctcctgtaagtgttgattgagcatccaccctgtcctagaccctgcttggtgctagggacataccagtgagcagggtggatgaggtcctcacccgtgagctcatatgctgatgggggagacctacagcaagcaaggagataaataaatacatcaaatagaggtaaatgatgtgaagaaaacaaaacgggctgagaagatagtgtgagactgtaaggagttttaaattttaaaacttgctactcataattagatattcaagtttctgaaattcgcatagtgcatttcagatgatgagagaggtgacagccgtagaaagtgggagaagtggttgcggggagatgggtgagcgatggaggtggcgagcaagttggagagatgcagggagagtcaggtgacaagaagagagtgtgctgaggacagatggcggacagacaggccgctgcccccaatttttggtgctctttcattcctgcactcaggcacgaggcagacaggaaagacaggcagtgctgcttcgtaacaggcatctttcttgccctaagtatacatcttagaatgtgtggagaaagtcacgctatgggagcacttgggcaggctcaggtgttcactgtagtagaaggagaatgactctagctgatgttgggaccctttgctgtcaccccgcagtccccacagtgcccggtgtgagttgtaagaaaatggtggtcagtgattgtcttcgcattttatatacgcacaggtcaaagagaatgaactctaaatgtttcccagtttgatttttctgcttctgtttagccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaaaaaaaaaaaaaaaaaaaaaaaaaaaaaaaaaaaaaaaaaaactcaggggggccccgtcccaattgcctatgagggcngttacaattaatgccgtgtttacacttggactggaaacctgggttccatttaaagctttgagaattcctttttcagttgc

SEQ ID NO: 328439 - DNA, 1537 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328440 - DNA, 1516 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaa

SEQ ID NO: 328441 - DNA, 1038 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatgtaatgcagttttcaatcaaaggccaagcatctctattttgaatgtagatcagcactaaaagccctgttttaatagcatttatactaattcctaccagtcctcacgaggagggtgacacacaccctgttcccacttgagagagggcatctgcaggggtggaggggagaccccatggctcggcctggtgccacagcctgcgggcctgccgcccaccagtgctctgcggtcccactgtggtccccgagtcccctcagagagagctcgggatcctctagatcaac

SEQ ID NO: 328442 - DNA, 767 bp, Homo sapiens
acgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgagtcagcattgcagacccacttctgggtgtgtggtgcgactttgcaagggctgtgatagactcaccttgcacttactgtgtttatgaatgtctgttagatagatgaataaatgccattacttaatcggtc

SEQ ID NO: 328443 - DNA, 331 bp, Homo sapiens
atgaaaattatgtatttctcaatatccttccctttcccctttagatattgaaaccctcaaaatcatctatggggaaaggaatagacctatctcccaggtgtgtatccttaactttggcaaataaacctcaaaaaatgattgagattttcctgggtcattttccttgattgaccacggagggatcctgagtgaaggtggccctggcctgcagcagctctcctattggtaccagattgggctctttatagcccaaaccaataagacaatttgttgaggtctgggacctcctccctgcaggaagttggggctctgaggtttaatttgatgttta

SEQ ID NO: 328444 - DNA, 222 bp, Homo sapiens
tttggtcgtggttcatccacacgtgtcctgaccctggctccagtaaagagtcctgctgtacacaaaactgactttggaggtggcatcgtggagactggggcattttccccacgagtcacagctcactgggccccccgaagcgcctgtgaaggatgcctgttcccaggagaatgacttctgtgtccccagtgctgaagccctcgctggaatgcaacccagtgg

SEQ ID NO: 328445 - DNA, 649 bp, Homo sapiens
agctccattcttgcccatattgcataacacaataccatgttgtgatttgtgtcttatgtccgtctccccaaccaacaatccacattcctcccatggtgtctgctgtggccaggtcaaggcctctcacagagtaggcagatgctcacgtgcccacagggattgccccagcagtgggagtggtccctcaggggactgggcccaaaagaacctagaacctcaggcctcctacacaatgggaacagatttggcccggattggaactttagacaccaggccaggcttctgcccactctatcctttgtcccacgaagctgccaaggatggcagttccagctggcaagtaataagaatttcttcctggaaggattcttggcttgagaactggcctttacctcgtctaggcttctttgatgccctcaagttgctggggacatggggaatgggagggagaggctgagtcggccccagcattgttactgttcccctaaaggccttgtgcccacttcttacctcctctaactgcacatggcagggattcccaagatcatgggttttccaaccctgagtagaggtgggggacgggactggcccaacatttgatgccaggagagtaacactgcctttggccacacatgtcccagccctaact

SEQ ID NO: 328446 - DNA, 410 bp, Homo sapiens
gggtaggaggtgaaaaatgctggctgcttgcgtcacttgggaagaaatcgtagtcctggatttggagctgggtagggttaactagttactagttagcttcagttttgtttcttcaagaatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccgggagtttgaggctgcagtgagctataatcttgtactgtactctattctgggtgagatcctgtctttaaaaaaaaa

SEQ ID NO: 328447 - DNA, 464 bp, Homo sapiens
catcgctgctgatatgcatgttatgtaacacttgtttctatagtatgagaaccgagagagagaaaaaaaaaagcttcctgacaagtaattttgtacgtaaaaaataatctgccagaggcttgggaaaatgtacctgtaattcttccacacattggcacttacacccgcttgcctgccgaccaattctgccttcaaacgccctgggagcaaaacaccattacacaagaaaggcaagaatgtcctttccgctttcagaatctgggaccaacagtgtgtgtgtgtgtgtgtgtgtgtgtgtgtgtgtcgagagagagagagagagagagagagagagagagagagcaccacaggggagacctacagaaaaaagaaaaacaacaaagtgaagaccactcccaccccccccttattcaaatacatatccctgagtagagagtgaaagagagtacatatatctcacacaa

SEQ ID NO: 328448 - DNA, 279 bp, Homo sapiens
ccagactccgttaaaaaaaaaaaaaagagagaaatactaaaaaagtaatacatgtaatcgaacaagagaaagttacccttgaccagtcccttactcctgccctcagccaaatcccaagagtgggctacacagataaccactgtttggtccagaccttttacctctgcatttatgcatatgcacacatgcatatgatggatcatcttttaaacatacaaataagatcatatgatagatatatatagatgtggttctgacatgctttttttgtttctattt

SEQ ID NO: 328449 - DNA, 320 bp, Homo sapiens
ctttcgacccccacattctcaccacctgtttctttgtttgatcaccaataaatagtctgggcttccagagctcagggccttcacagcctccatacttagcgatggccccctggacccactttcgctctcaaactgtcttttctcattccttcgactccaccagacttcgtcacccccacgacctggtgttgggtctgatcaccccagcaaaaattaaatagaagagtaaaacataagcccctcttagaaataaaacaaaacaaagaaatctttgcaactttgagtttggcagagttcctacatgacaccaaaatgatgac

SEQ ID NO: 328450 - DNA, 251 bp, Homo sapiens
agaagagcaagttagtaccttgtaccaaaacatcaaccttgtggagccaagattaattcagccatatgaacatgttataaagaacttcatccgtgagatcagacttcaaagcacagaaatggaaaatttggccattgcggtgaagagagcccaggacaaggcagctatgcagttgagtgagttggaagaggaaatggatcagaggattcaggctgcagaacataagacacggaaagacgtgagtttctggg

SEQ ID NO: 328451 - DNA, 1108 bp, Homo sapiens
  misc_feature (36)..(36): n is a, c, g, or t
caccacaggaccccagcaaatcattaatctggactnctatgattaaatgagcacaatgcagaccatccccctatttacagaagagtaaattatgttaaattcttcaatttagcagaaaggcattcttccgaaacctttcagaaccactgttatttacccatttaccaaggcaacattctccccaaataaaattttaaatgatattgccttaaacaccaataattttttttttcctcaatgctagtcttaactgagagatttttaggcagttaactctcccagcacagcaataagcagcttattagtagatattatctcttgttgatttgttacccttgagatttactgtgcttgcaaaacacctgtctgtatttgagctttgctaggtagttggcttttgtgtttgactgaagattttttccaaagaaagcaaatagctattaggaaaagaaagagtcagcaaatttctgtatgctttcatggaagagatttcccaattagaaagcttttgtaggcttaaccttttgccctaaagtaacccaacatttcattatgtattccattgaggttttggagctcggcaccagaaagcgaggaccaaggttgaatgtgaaaggaatattcagaggatgaagctcatagtcaacaaagtgctgcttcataggctaggtccaaaaataacctgcttgccatagggagcaagaatggaggtagcattagctgctgttttgagcagtgtttcatgtcctgtcatgtcattccagaatggttttttggttttgtttagagacagggtcttgctctgttgaccaggccagagtgcagtgtggtgtgattgtagctcacagtcacctcaaactcctgggctcaagtgatcctcccatctcagtttcctgaatagctgggactacagacacacaccattgcacttggctagtggttttatttttagtatagacagtgtctcggtttgttgcctaggctggtctcaaactcctggcctgaagcagttatcctaccttggccttccaaagcactggaattataggcatgagcagccacacctggtctcattccagaataattaaaattatgtttaaggcagccg

SEQ ID NO: 328452 - DNA, 595 bp, Homo sapiens
tgttctcaaagagcataataggggttttgtgactttcagactttcctgaaaaagcctaaccgtggattttagaattattaagctagaaaaatacacacatacacacacaggtttgtttgggacccttagtctccaccctggaattaagtgacactgaaaataactctggaataaaaggtttttatgtagcagaatagttgacttacaggggttcttccctttgcacattttctctgggtagaaaatgagcttgtttttcttttagttgtattacaattttttttttcctcaatgctagtcttaactgagagatttttaggcagttaactctcccagcacagcaataagcagcttattagtagatattatctcttgttgatttgttacccttgagatttactgtgcttgcaaaacacctgtctgtatttgagctttgctaggtagttggcttttgtgtttgactgaagattttttccaaagaaagcaaatagctattaggaaaagaaagagtcagcaaatttctgtatgctttcatggaagagatttcccaattagaaagcttttgtaggcttaaccttttgccctaaagtaaccc

SEQ ID NO: 328453 - DNA, 501 bp, Homo sapiens
aaattcaaaggattccgatcattcagagtatgttctctgatcacaatggaattgatagaaatcagtatcaaaatatccttagaaacccccctaaatatcaagaatctaaataatagactttttagtaacccttgaattaaagaagaaatcaaaaggcaaattaggaagtagtttgaatggaatgaaaaggaaaagacaatataccagaatttgtgggatgcacctaaagcaaaacttaaagaaaagtgtatagtgctatattggaaagaagaaacttctcaaatcactgacctcagcttccaccttaagacactagagaaagaggagcaagtaaagcccaaagtaaacagaagaatggaaataataaaaatcagagcagaaatcattgcagtgaaatacagaaagccaacagaaaccaatgaaaccaaaagctggtcctttgagaatttcagtaaaattgacacacctttaatcaaaatgatcagaaaaaaagaaaacaca

SEQ ID NO: 328454 - DNA, 430 bp, Homo sapiens
aatatgaagaaccatatacgtttaaagcaaaagaatggaaaaagatatgttaatagatctggagtgggtatattagtatcaaagtagatttctgagcaaaggatattaccagagataaagaatgttatatcctaatgataaagtggtcagttcgtcaagagaatgtaagttctaaacatttctgcacttaacagtgcttcaaacatattaagcaaaaactaatagagctgcaagaagaaatacacaaattcacaattacgtttgcagttttcagtaccttttaataatttttagaataattaggcaataaatcagcagggatatagtagaaaagccaacagaaaccaatgaaaccaaaagctggtcctttgagaatttcagtaaaattgacacacctttaatcaaaatgatcagaaaaaaagaaaacaca

SEQ ID NO: 328455 - DNA, 160 bp, Homo sapiens
gtagctcaaaagcccccaagatgtgactgtgttccaataaaactttattaacagacacatagggggctggatttaacctatgcaaggctaatttttttgtttttgatgttttgtagagatgaggtcttgctatgttacccaggctgggtttttttttttt

SEQ ID NO: 328456 - DNA, 372 bp, Homo sapiens
cccacagaaatgaaacagacaaggacttgaaggcagtaagatggagttacacctgaggttaatttgtttgtctactggctatcctactctagaaaatttacttaacccaagtttcttcacctttaaaatagggtaacagtgtccacttcatagaattgtttgtaaggacaatggacggcatctaacacatagtaggtcgttaatacatggtaatgacaatatatccaagagtgggataatactatttattgagtacatgccatccactatttaatgaaagacgtaatctatatgaaaagacacaaggctggcatggtggctcacgcctataatcctagcactttgggaggccaaggcaggaggatgacttga

SEQ ID NO: 328457 - DNA, 199 bp, Homo sapiens
atgataatggatttttgtttaaaatttttgttgttcattctaaatagggtaaatgtgaaaatccattttgttaaattaatggtgtatgcttagtagacacaaagtgaaaaaaatgataaaatctggtttgtattgtttgaaaataaaaaattttctgtgattaatatgtttataattttagagttggaaaacataaaaa

SEQ ID NO: 328458 - DNA, 286 bp, Homo sapiens
tcccccctggtctgtacttaggcgaggtgagtgatccaggcatgggagaacatgcagatggaagcctcgtgctcccagagtttctgactattcaccatgcactcatcccccttcctggcccagcccctattcctgcacctcactctttgagagcccaggttctccttcctcagtcacctcagagaacctctcttgatcctcattcccctttttgtctcctgttccacccctagcctttgtctgaactcctcattctctccactccaccagaattctttccctaagt

SEQ ID NO: 328459 - DNA, 342 bp, Homo sapiens
acagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgct

SEQ ID NO: 328460 - DNA, 137 bp, Homo sapiens
aaaaatctttgagtaccaataatatcaaaatctatccatgattgaaagctcactatatgccaggagttgtgcaagagttgtatatacatcacctcataatgagtagaaaacctaatttcttgtttttgtaattgtcg

SEQ ID NO: 328461 - DNA, 209 bp, Homo sapiens
gggagagattaggacttctgtttgggacatgttagaatggagatgccgctcagataatcaggtgcagatgttgcatagaaagtagaaaatgtagatcaagagttcaggggagaggtctgggctgaagaatgaatatttgggagtcctcagcctgtagatggtactgaaagcaaagagactggatgtactcggctagggagtaattggag

SEQ ID NO: 328462 - DNA, 116 bp, Homo sapiens
tgactgattagcttctagtgaatacagtgtgatgggaggaagggtgtgggactttggagactgggtcattaagggcactgcgggttcctcctgtgtcctctctcggatcactcgtt

SEQ ID NO: 328463 - DNA, 533 bp, Homo sapiens
cacggcctgccctgggagccccatatcagtgtctgacttccccatctcatcaaccaaagtgggctgctggcacggccaagagcaattactttcgactgttaattgtctggcgctgccaatggccagaagagtcgactccccttgggttgagaagccagggacgtggcagagtgctgggaatctgtgccctggcagacacagagccagagctgtgggctccgatccgtatccagatcttggcctgccacgtgccaggtgagtcccaggcacatctctcctatctttttgccgtgtcatctggcccgacccttctgggggcttcaaggacactggcctctcgccttctgccaccctggtggaggcagatcaatgccatgtcaaaaacaaaggtactgggctcaaatggatctgcgtctgaagcatggctcccctcaaccagctgtgtgaccttgggccagtcacttggtgtctctgagcctccgtacactgagatcatacaggacctagcctcaagggtggctgtggaaactgag

SEQ ID NO: 328464 - DNA, 803 bp, Homo sapiens
ttctttttttttttctgggcacagaaaaaaattgctagcctaagtcactctggtttcctacattggtttttattgtttgaagcagtaagcagtaatggtgtcctgctttttttttccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328465 - DNA, 965 bp, Homo sapiens
caaatgccaaagcagaaagactgtgaagttacaacagaaaaactacaggagtgtagcaatgcagtttaatggctttgagaagcatggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctaaaacaacaggatactataattactcgccttggcctcggcgggcctaagcggtggacctctggggccctttccctttaatgaggggtaattcctgaatctttggtcactgaactcgttcgctaggcctttcggttagggtgagcgtgatacacctcacccaagggagaattactggttttcaccagatctggtgag

SEQ ID NO: 328466 - DNA, 907 bp, Homo sapiens
  misc_feature (790)..(790): n is a, c, g, or t
  misc_feature (798)..(798): n is a, c, g, or t
  misc_feature (811)..(811): n is a, c, g, or t
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccccntggttccnttctttggccccntgggtttcccatgcactgggatggtggcccgtcacatctgtggcagtggttcttgtgggtaacccaaacacgacataaagcccagaaaaacttcgt

SEQ ID NO: 328467 - DNA, 3832 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328468 - DNA, 4078 bp, Homo sapiens
ttgacccttatgatggatgaggaaaagtatcacatcttcccgccgctacagtggaaatttcagaaatgaagactcaaagacccagaggaaatttaaaaaaattcatagatgaaccatgtagcctggaaatataaaaaaaaaattaagaaaacagttgcagaaaaatagaaagatctaaatggaggacttacaaaatatggagctcttaaataacggacttgaaattgagaattattacaagccattaatcattatagatctccccggaaatgaatgaatgagaatttatcattgctcttattaggtacgtgcctccaatacttcttcaggaggattttctgaagccccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328469 - DNA, 3481 bp, Homo sapiens
ttgacccttatgatggatgaggaaaagtatcacatcttcccgccgctacagtggaaatttcagaaatgaagactcaaagacccagaggaaatttaaaaaaattcatagatgaaccatgtagcctggaaatataaaaaaaaaattaagaaaacagttgcagaaaaatagaaagatctaaatggaggacttacaaaatatggagctcttaaataacggacttgaaattgagaattattacaagccattaatcattatagatctccccggaaatgaatgaatgagaatttatcattgctcttattaggtacgtgcctccaatacttcttcaggaggattttctgaagccccagtggctgctgttgtttgagtttggtttggagcaaaactgaggtagtcctaacatttctgggactgaatccaggcaagagaaagaagaaaaagaagaagaaaaagaggaggaaaaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328470 - DNA, 3751 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328471 - DNA, 4027 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctaaaacaacaggatactataattactcgccttggcctcggcgggcctaagcggtggacctctggggccctttccctttaatgaggggtaattcctgaatctttggtcactgaactcgttcgctaggcctttcggttagggtgagcgtgatacacctcacccaagggagaattactggttttcaccagatctggtgag

SEQ ID NO: 328472 - DNA, 3701 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatgccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328473 - DNA, 2938 bp, Homo sapiens
  misc_feature (2927)..(2927): n is a, c, g, or t
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaatggaaaagcttgagaaaccagagaaggagaagaaaaaaaagatgaagaatgagaacgcagacaagttacttaagagtgaaaagcaaatgaagaagtctgagaaaaagagcaagccagagaaagagaagagcnagaagaaaaaa

SEQ ID NO: 328474 - DNA, 222 bp, Homo sapiens
tacattggtttttattgtttgaagcagtaagcagtaatggtgtcctgctttttttttccaggttccggtggaggaggaggttgctggtgatctctgctcctaacgatgaagactgggcctattcacagcagctctctgccctcagtggtcaggcgtgcaattttggtgagtgggaagccacctcattactgctttcccataccactctcctcctggtcaatt

SEQ ID NO: 328475 - DNA, 359 bp, Homo sapiens
gaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328476 - DNA, 3866 bp, Homo sapiens
gtagacagatcatgccctccgtatacccgcctggtcctcctcaattgctatctacctaagtgccacagtggaacacaacattagatctcaatgaaaaccagaatggaaccctttcactatcataaactcatttataaaagtgcccatgatgaatagcaagaagtacccagtggcccatctcattgaccaaacttagaaagccaaggtggggcatctgcagctctcccacaatctgagtttgtgttgatccttgtaccccacaacctgaaacatcttcttatatatatcgagcgagctctcagcccttctgttttcaaggccatcatggagaaactggagatgtccaagttccagcccactctcctaacactaccccgcatcaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328477 - DNA, 3773 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 328478 - DNA, 4656 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgtatttaaagctttttcttattttttgtattaattggtaagtgaaaactctgttaaagatcacaccacaatgttttcaagaaacatctgaaaagataaaacaaagaacaaataacttataatacttacttaaattgacactttttgaaatgccagtctgaaaataattaagatatctctgctttgtatgagtttcttttatgaaacttgataccacgggagtccagtaatattggccacaaaagccagagaaagtaccaagcccagctttgttatcatagccacttcctgccctgcttctgttatttttagtgttttttcagatataaatcggggtccaggaaatcctcaccagaatctggcactgcagccaaaggcgatacttccagagttctagtaggctgctatggaatttctggcatgaaaattcttgacccctcacactttaccccctgtacagcacaggcataccatggagatattacaggatcagttccagaccaccataataaagtggatatcgcaataaagtgagtcacacaaaatttttggtttctcagtgcatataaaagttatgtttacactctttagtagtctattaagtgtataatagctttatgtccaaaaaatgtacatgttttattttaaaaatactttattgcta

SEQ ID NO: 328479 - DNA, 3682 bp, Homo sapiens
gccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctaggttctcttaaacattttaattatattattgtttttctcatatctaaggtgggacaaactttatggtagaggtacatgggggatccaaaagaaaatgaagatgttcagagggctctttggttgtgataacacaggtcagtttgcctgcttatttaaatagccattccaggatggttctcgtttaagttttaagcactgtaaaaaagaaaaatacgcaaacactctattgtctgaaagtcagtaaggtggaagaaaatgggaaaagtaacacagtgtgggagagaatcagagaggcattcagacactttttctgggtactgagtcttctcgcctgtgagcagccccgtctgatcttcctgcagactctccgctgcaggtgactcatcacagatgggacttgccagactctcggaagtacttgactctggcaagcctgaggaaggaattaaccagaactgagagaagctgttaagataaatgaaaagtcactgaaaatatggactgaactgcacccaagtccttttggagagtagaagaatttggctgaatttagagttttcgcaattttacatatgaatggtgcatgtgagactcatgaggcgtacagcccagtgttggacagctgagatctaactcattgcagttctcctgggaacgttgcaagatttactgtgattagttaagcctcatagtcagaagcccaaaatatgacccacccagtttatttcataattattgcatctctagggctttattttttaaaaagctttttttcttatatgcactttctactgttttgttgttgttcatggtttaactac

SEQ ID NO: 328480 - DNA, 2136 bp, Homo sapiens
agtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagcacgtgaggggacatgcagggactgcccgtgtgaacggcttcaaccgcatgccccccaccccacagtcgccaagaagactgggaggtccgcatcggcggtgggtacaacgtcattcaggctgcgaggcgagtcaggcctttccagacctcgccggactgggttgggctgcgccggaaattgaccggaacagggactatgagaaaatagttgagcaatcgaggagtcagctgaaaagcggaggctcaagagccatttcaagctgggctgtaccagaaattgattggaatagggactatgagaaaatagtcgggcaaaggaggagtaagctcaaaagtggagtctcaaagccatttcaaccttcccgccccagccagtcgaagcagtggcgcggggcctcccaagcccaggagccggagatggaggaggtggtggaagagttggggctgcctttgcagctttccaccctaggcggagggaacctgccagggggcgtgcggaggtccgcaatctgagaccgcgaaatggcttacagctggacgtgattgccaagacccttctgggctgcttccagaagcgcggaggctggggtgctgtgcgcactggggagcacatgaggggacatgcagggactaccggcgcgaatggcttcaaccctacgccccccaccccacatttcacagttgccatgaagaccgggaggtctgcaaaagcagcgggtacaagtcattgaggccaagaggcgagtcaggcctttctagacctcgcccaactcagctgggctgcgctggaaattgaccggaacaggaactatgagaaaatagtcgggcaaatgagaagtaagctcaaaagcgtaggctcaagagccatttcaagccgggctgcgccggaaattgaccagaacagggactatgagaaaa

SEQ ID NO: 328481 - DNA, 3200 bp, Homo sapiens
agtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaagatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgcactggagctggagaatttgcttctagggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggcaaagaaaaaagaaaggaggaaggggtgttggagcagattgtagttgatccacagcaaagagcatcaccaaagccattccaggaggaactagatccaccacttcctctgctgggcatgctccaaaaatggttgtggcctccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgactccaagcacatccaggaatgcacttactgataagatattgaggcaagctgtaccagcagctcctggggacgtgctcagtggatggtacccaagcccctgcatttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaattagaaaaaaaaaaa

SEQ ID NO: 328482 - DNA, 3070 bp, Homo sapiens
ttttctcatagtccctattccagtcaatttctggcacagcccagcttgaaactgctcttgagcctccgattttgagcttactcctggtttgcccgactattttctcataatccctgttccggtcagtttccggcacagcccactaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaagatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgcactggagctggagaatttgcttctagggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggcaaagaaaaaagaaaggaggaaggggtgttggagcagattgtagttgatccacagcaaagagcatcaccaaagccattccaggaggaactagatccaccacttcctctgctgggcatgctccaaaaatggttgtggcctccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgactccaagcacatccaggaatgcacttactgataagatattgaggcaagctgtaccagcagctcctggggacgtgctcagtggatggtacccaagcccctgcatttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaattagaaaaaaaaaaa

SEQ ID NO: 328483 - DNA, 2398 bp, Homo sapiens
agtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaagatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgcactggagctggagaatttgcttctagggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggctccccctgccctatttagaccacggtataaaaagaaatctatccccttcttcggggctgagagaattttgagctctagccatctctcggtcactggcaataaaagaactcctgaattagaaaaaaaaaaa

SEQ ID NO: 328484 - DNA, 1466 bp, Homo sapiens
agtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaattagaaaaaaaaaaa

SEQ ID NO: 328485 - DNA, 1380 bp, Homo sapiens
agtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaatgaaagaaaaaataattatacaaactcccttcgtcccattgcctcccttctgttataacgtgtttaaatttatcgtgtatttatattttaatgttcctctcgaatgcaatacaaattattttatagaggaaggcatgtaaactaaggtaccaggatacgggaaaggaaaaaaggtgaggaaaaggcaatataagtcaagtaagctgatcaagtggggtactgctagcctagctgc

SEQ ID NO: 328486 - DNA, 1193 bp, Homo sapiens
ttttctcatagtccctattccagtcaatttctggcacagcccagcttgaaactgctcttgagcctccgattttgagcttactcctggtttgcccgactattttctcataatccctgttccggtcagtttccggcacagcccagcttgaaacagctcttgagcctccccttttgagcttactcctcctttgcctgactcttttctcatagtccctgttctggtcaatttccggcgcagcccggcttgaaatggctcttgagcctacgcttttgagcttacttctcatttgcccgactattttctcatagttcctgttccggtcaatttccagcgcagcccagctgagttgggcgaggtctagaaaggcctgactcgcctcttggcctcaatgacttgtacccgctgcttttgcagacctcccggtcttcatggcaactgtgaaatgtggggtggggggcgtagggttgaagccattcgcgccggtagtccctgcatgtcccctcatgtgctccccagtgcgcacagcaccccagcctccgcgcttctggaagcagcccagaagggtcttggcaatcacgtccagctgtaagccatttcgcggtctcagattgcggacctccgcacgccccctggcaggttccctccgcctagggtggaaagctgcaaaggcagccccaactcttccaccacctcctccatctccggctcctgggcttgggaggccccgcgccactgcttcgactggctggggcgggaaggttgaaatggctttgagactccacttttgagcttactcctcctttgcccgactattttctcatagtccctattccaatcaatttctggtgcagcccagcttgaaatggctcttgagcctccgcttttcagctgactcctcgattgctcaactattttctcatagtccctgttccggtcaatttccggcgcagcccagcccagtccggcgaggtctggaaaggcctgactcgcctcgcagcctgaatgacttgtacccaccgccgatgcggacctcccagtcttcttggcgactgtggggtggggggcatgcggttgaagccgttcacacgggcagtccctgcatgtcccctcacgtgctccccagtgcacgcggcacccccgcctccacgcttccctgagcgtgcagcctttggtgagggcagccccacgcacag

SEQ ID NO: 328487 - DNA, 753 bp, Homo sapiens
ttaaaagcaagagactttgtaagatgaggagagtgggtttaagagttagagggttgctgcaattccttattgagaggacagagctggaaggaattattgatcagaggttttacttaaagtccacgatgactccacagattctgtttgaagccactaccaaagaaagaattctcaaatgtttactgtagctaaagaaaaactgttgagaaagaaatgctgtaactctaatgtgctataaattcttctgagcttgctgtggctaatttattaatttaaaaagtattttttgtctttcttaggcctccttgaatctagtcactctagagatagaatacacaatcttgtcctgatgtttttacttgcaactcacaatcttgtttggtggtttagtttgcaggtttcagagattagaccgtatatatctaaatgctgggatcatgcctaatccacaactaaatatcaaagcacttctctttggcctcttttcaaggtaattttcattttatggatgaactgattggaaggaatgtgttcatttttctgcctagttttgatggcgtgttaagttggggggatgaaaggtaaggggttgttgaaaaggttgagccctaacaggagcccgctcagcccctcatttgatacgcctgcctctcaacccttccgatgcatctctctggtccctcttcccttcataggcaccatcctctccgccggccttccgccactttccctcgccgccggtctccctttccc

SEQ ID NO: 328488 - DNA, 449 bp, Homo sapiens
gatggtctagacctggcttattctggaattgctacctttatcaggtgttattctgtgttctggctcttagaatgatgcccccctgggtgacagcgagaccctgtctcaaaacatatatatatttaatatatatgtaaagccagagctgacaatgacactctggaacattgcataccttctgtacattctggggtacatggatttctactgagttggataatatgcatttgtaataaactatgaactatgactctcttttccttccttttggaattatctccaagactgtgtatgtgtatgcatatgagaaaaagattgggccgggcacggtggctcaagcctgtaatcccagcactttgggagcctgaggtgggcgcatcatgaggtcaggagtttgagaccagcctggccaacatggcaaaaacccatctctactaaaaatacaaaac

SEQ ID NO: 328489 - DNA, 243 bp, Homo sapiens
acccacctcggcctcccaaagtgctgggattacaggcgtcagccattgcgcctggccagtaccacattttcaatctcaatcatgatcataattatttcatggagactaatttataagtacatcctgatgtgtgatcagttggtgctgggattacaggcatgagccattgcacccagccagtaccacattttcagtctcaatcacgatcataattatttcatggagactaagttatgagtacat

SEQ ID NO: 328490 - DNA, 1746 bp, Homo sapiens
gaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgctgaggtcaccattgtccaggtggatgtcagcaacctgcagtcattcttccgggcctccaaggaacttaagcaaaggatgatcaagaaatggttgtatgtgatccgtgttgaagaccatttgcaggtttcagagattagaccgtatatatctaaatgctgggatcatgcctaatccacaactaaatatcaaagcacttctctttggcctcttttcaagaaaagtgattcatatgttctccacagctgaaggcctgctgacccagggtgataagatcactgctgatggacttcaggaggtgtttgagaccgatgtctttggccattttatcctgattcgggaactggagcctctcctctgtcacagtgacaatccatctcagctcatctggacatcatctcgcaatgcaaggaaatctaatttcagcctcgaggacttccagcacagcaaaggcaaggaaccctacagctcttccaaatatgccactgaccttttgagtgtggctttgaacaggaactttcaaccagcaggtgctgtattcgtctgtgtatgtcattaaatacctgcctcattacatggaggtgggtctaagtattaccattttcagatgaggcactaaatcttggagaacttcgcttttttgcaaatgcattcactttgacaccatataatggaacagaagctctggtatggcttttccaccaaaagcctgaatctgtcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagatgatcaggccaggctcagtggctcatgcctataattccagcactttgggaggccaaggcagaaggatcacttgagaccaggagttcgagaccagcctgagaaacatagtgagcccttgtctctacaaaaagaaataaaaataatagctgggtgtggtggcatgcgcatgtagtcccaactactcaggaggatgaggtggggggatctcttgaggctgggaggcggaggttgcagtgagctgagattgtgccactgcactccagcctgggtgacagcgagaccctgtctcaaaacatatatatatttaatatatatgtaaagccagagctgacaatgacactctggaacattgcataccttctgtacattctggggtacatggatttctactgagttggataatatgcatttgtaataaactatgaactatgactctcttttccttccttttggaattatctccaagactgtgtatgtgtatgcatatgagaaaaagattgggccgggcacggtggctcaagcctgtaatcccagcactttgggagcctgaggtgggcgcatcatgaggtcaggagtttgagaccagcctggccaacatggcaaaaacccatctctactaaaaatacaaaac

SEQ ID NO: 328491 - DNA, 1703 bp, Homo sapiens
gaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgctgaggtcaccattgtccaggtggatgtcagcaacctgcagtcattcttccgggcctccaaggaacttaagcaaagttgcaggtttcagagattagaccgtatatatctaaatgctgggatcatgcctaatccacaactaaatatcaaagcacttctctttggcctcttttcaagaaaagtgattcatatgttctccacagctgaaggcctgctgacccagggtgataagatcactgctgatggacttcaggaggtgtttgagaccgatgtctttggccattttatcctgattcgggaactggagcctctcctctgtcacagtgacaatccatctcagctcatctggacatcatctcgcaatgcaaggaaatctaatttcagcctcgaggacttccagcacagcaaaggcaaggaaccctacagctcttccaaatatgccactgaccttttgagtgtggctttgaacaggaactttcaaccagcaggtgctgtattcgtctgtgtatgtcattaaatacctgcctcattacatggaggtgggtctaagtattaccattttcagatgaggcactaaatcttggagaacttcgcttttttgcaaatgcattcactttgacaccatataatggaacagaagctctggtatggcttttccaccaaaagcctgaatctgtcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagatgatcaggccaggctcagtggctcatgcctataattccagcactttgggaggccaaggcagaaggatcacttgagaccaggagttcgagaccagcctgagaaacatagtgagcccttgtctctacaaaaagaaataaaaataatagctgggtgtggtggcatgcgcatgtagtcccaactactcaggaggatgaggtggggggatctcttgaggctgggaggcggaggttgcagtgagctgagattgtgccactgcactccagcctgggtgacagcgagaccctgtctcaaaacatatatatatttaatatatatgtaaagccagagctgacaatgacactctggaacattgcataccttctgtacattctggggtacatggatttctactgagttggataatatgcatttgtaataaactatgaactatgactctcttttccttccttttggaattatctccaagactgtgtatgtgtatgcatatgagaaaaagattgggccgggcacggtggctcaagcctgtaatcccagcactttgggagcctgaggtgggcgcatcatgaggtcaggagtttgagaccagcctggccaacatggcaaaaacccatctctactaaaaatacaaaac

SEQ ID NO: 328492 - DNA, 1677 bp, Homo sapiens
ttaaaagcaagagactttgtaagatgaggagagtgggtttaagagttagagggttgctgcaattccttattgagaggacagagctggaaggaattattgatcagaggttttacttaaagtccacgatgactccacagattctgtttgaagccactaccaaagaaagaattctcaaatgtttactgtagctaaagaaaaactgttgagaaagaaatgctgtaactctaatgtgctataaattcttctgagcttgctgtggctaatttattaatttaaaaagtattttttgtctttcttaggcctccttgaatctagtcactctagagatagaatacacaatcttgtcctgatgtttttacttgcaactcacaatcttgtttggtggtttagtttgcaggtttcagagattagaccgtatatatctaaatgctgggatcatgcctaatccacaactaaatatcaaagcacttctctttggcctcttttcaagaaaagtgattcatatgttctccacagctgaaggcctgctgacccagggtgataagatcactgctgatggacttcaggaggtgtttgagaccgatgtctttggccattttatcctgattcgggaactggagcctctcctctgtcacagtgacaatccatctcagctcatctggacatcatctcgcaatgcaaggaaatctaatttcagcctcgaggacttccagcacagcaaaggcaaggaaccctacagctcttccaaatatgccactgaccttttgagtgtggctttgaacaggaactttcaaccagcagcttcgcttttttgcaaatgcattcactttgacaccatataatggaacagaagctctggtatggcttttccaccaaaagcctgaatctgtcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagatgatcaggccaggctcagtggctcatgcctataattccagcactttgggaggccaaggcagaaggatcacttgagaccaggagttcgagaccagcctgagaaacatagtgagcccttgtctctacaaaaagaaataaaaataatagctgggtgtggtggcatgcgcatgtagtcccaactactcaggaggatgaggtggggggatctcttgaggctgggaggcggaggttgcagtgagctgagattgtgccactgcactccagcctgggtgacagcgagaccctgtctcaaaacatatatatatttaatatatatgtaaagccagagctgacaatgacactctggaacattgcataccttctgtacattctggggtacatggatttctactgagttggataatatgcatttgtaataaactatgaactatgactctcttttccttccttttggaattatctccaagactgtgtatgtgtatgcatatgagaaaaagattgggccgggcacggtggctcaagcctgtaatcccagcactttgggagcctgaggtgggcgcatcatgaggtcaggagtttgagaccagcctggccaacatggcaaaaacccatctctactaaaaatacaaaac

SEQ ID NO: 328493 - DNA, 659 bp, Homo sapiens
gaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgctgaggtcaccattgtccaggtggatgtcagcaacctgcagtcattcttccgggcctccaaggaacttaagcaaaggtatatctcttgctgatggattttttttttctcgtgtgattgtgcagcataacacttaataaaataagagaggaaagaaaaacctaaaaagaaacaggtgcggtgtaagcagttatgttgaagaagtctgtatagggtgacccactgtgtctcagtaccacgttttctttctttctttttttttttttaaagagatagagtcttgctctgttgcccaggctggagtgcaatggcggtgatctcggctcacttcaacctctgcctcctgggtccaagtgattctcctgctcaacctcctgagtagctgggattacagacttgcgccaccatgcctggttaatt

SEQ ID NO: 328494 - DNA, 1603 bp, Homo sapiens
gaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgctgaggtcaccattgtccaggtggatgtcagcaacctgcagtcattcttccgggcctccaaggaacttaagcaaagttgcaggtttcagagattagaccgtatatatctaaatgctgggatcatgcctaatccacaactaaatatcaaagcacttctctttggcctcttttcaagaaaagtgattcatatgttctccacagctgaaggcctgctgacccagggtgataagatcactgctgatggacttcaggaggtgtttgagaccgatgtctttggccattttatcctgattcgggaactggagcctctcctctgtcacagtgacaatccatctcagctcatctggacatcatctcgcaatgcaaggaaatctaatttcagcctcgaggacttccagcacagcaaaggcaaggaaccctacagctcttccaaatatgccactgaccttttgagtgtggctttgaacaggaactttcaaccagcagcttcgcttttttgcaaatgcattcactttgacaccatataatggaacagaagctctggtatggcttttccaccaaaagcctgaatctgtcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagatgatcaggccaggctcagtggctcatgcctataattccagcactttgggaggccaaggcagaaggatcacttgagaccaggagttcgagaccagcctgagaaacatagtgagcccttgtctctacaaaaagaaataaaaataatagctgggtgtggtggcatgcgcatgtagtcccaactactcaggaggatgaggtggggggatctcttgaggctgggaggcggaggttgcagtgagctgagattgtgccactgcactccagcctgggtgacagcgagaccctgtctcaaaacatatatatatttaatatatatgtaaagccagagctgacaatgacactctggaacattgcataccttctgtacattctggggtacatggatttctactgagttggataatatgcatttgtaataaactatgaactatgactctcttttccttccttttggaattatctccaagactgtgtatgtgtatgcatatgagaaaaagattgggccgggcacggtggctcaagcctgtaatcccagcactttgggagcctgaggtgggcgcatcatgaggtcaggagtttgagaccagcctggccaacatggcaaaaacccatctctactaaaaatacaaaac

SEQ ID NO: 328495 - DNA, 1079 bp, Homo sapiens
gaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgctgaggtcaccattgtccaggtggatgtcagcaacctgcagtcattcttccgggcctccaaggaacttaagcaaagttgcaggtttcagagattagaccgtatatatctaaatgctgggatcatgcctaatccacaactaaatatcaaagcacttctctttggcctcttttcaagaaaagtgattcatatgttctccacagctgaaggcctgctgacccagggtgataagatcactgctgatggacttcaggaggtgtttgagaccgatgtctttggccattttatcctggtaaagaagctgtgggcttaataagctaatatttggtgtgatagttcgtgtaaagctctgggcacagggcattattatagttgagcagccagttaactgatttaatctcatgtttgagttttcttgattgcatttgccttgtttattgtgagcatggaatacttctggaagctttcctagtagatttttctttaataaatgtactaatagtttttgatttacagaattactgcaaagatagtacagagactttctgtatgccctacacccagtttcccctattattaacatttcgcattggtatgatgcatttgtcgaaatagatgaatcaattctgctacattattattaactaaagtacacactttattcaggttctgtttttgcctaatgtcttttttcagttctaggatcccattcaagatactacattacatttagcagtcatgtctccttaggctcttcttggttgtgacagcttctcagactttccttgtttttgatgaccttgacagttttgaggagtactgcttaggtgttttgtagac

SEQ ID NO: 328496 - DNA, 912 bp, Homo sapiens
aggataaataaaatgaaaaccacatgaaattacaccattgtaaaactgctgataaccaaagatggaaaaagtataaagaagccaaaagaaatattactttgaaaggagcgacaattaagctaatagctggcattttttctttctttcttaaatgcttgatagaatacaacagtgaaactatccagacctggagttttctctgttgaaaggttttaaccacgaattccatttcttttacggatataggacattgtgaagcttttcttgagcaagctttggtagtttgattgtgttaattatctattgctacacaataaattattgcaaaacttaacagcttggaaaaataaacagttatctcacagtttctgtgggtcaggaattcaggagcatttagctgagtagttctggctcaggatcaagaatgggtcaagatgttaactaaggctgaagccatatgaaagcttgactggggctagagtatctgcttccaaggtggcccactcgtggtttttggcaagaagcctcatttccttattggctattgacaggaggcctcagtttctcactgatagaaaggctcaaggtattgctgattggcagaaggcttcattttccaactacatgggcctctccatagtgctgatcaagtatccttaaaaaaagaaaaggtagctgttttcttgccaagtgagtgagccaagagaaagggcaaagaagaaaccacaggccaggcgtggtggctgatgcccttaatcccagcactttggaaggccgaggtgggtggatcacctgagctcaggagttcaagaccagcctggccaacatggaaaccccatctctactaaaaagtagctgggtgtggtggcaggcgctagtaatcccagctacttgggaggctgaggcaggaga

SEQ ID NO: 328497 - DNA, 329 bp, Homo sapiens
caccatgcccagctaattttttgtatttttagtagacacggggtttcatcatgttagccaggatggtctcgatctcctgacctcatgatccacctgcctgggcctcccaaagtgctgggattacaggcatgagccaccacgccgaggtcacattcttagtgtcactggcaaagaagtctgagaaaaaaggttaaacccagaagaaaaaggaaaacaggccctctcagcaccagggggcagctccggcccttccccaagcaggctgttctctgcgttccagcaggctgagggcactcaggcaaagagaatgccacagaaggagcctcagg

SEQ ID NO: 328498 - DNA, 1392 bp, Homo sapiens
gaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctctttgtgtatgtccaccacagttactttatcccttcatctgtggatgggcaggctaaacaatattcacagcattttcaccaggagtaaatttcatctcacaaaaccactttccaggctctttctggactgtagagttctttccaggctaccttgtggcagtttaagagtctggcatcattttccgctgggacctaaggatcgaggaggtgcttgtgactagactgccaatggacccatcacaaagtttaacccaaccttgatccccgagtcttcacaaatgctcactgaagaaaattcctggaacaattcagggtcctttcataacctctactctgaggtgttaataaaaaaccttagtaacttaaaaaaaatgagctgtacacaaatactgaacaataatgctacatatgttaagtatgtaagaaaaatatatactttgacataaataagaaacggtgagttgataattggatagaatggtggatagagtgatagatatgtagtaaagcaaatataacaaaatgataattgtacaatctaagtggttggactataaatatgcacttcccacaacatttttatatgtttaaacagttttataataccatattagggaaactgtttgtctcaaggaaatagagattgtgatatgttctagtacaatgaagtgtaatcatgtaaaataaaagcttttacttctggcaattaaagttaatcatgttagaacactgtctaggaatggttggaaaatcatattttattttctaatcaatatatttatgtcatctgtcaatcagaattacactgactttaaaa

SEQ ID NO: 328499 - DNA, 1484 bp, Homo sapiens
gaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctctcaacatctcttcttaattggagaaagtgttaagccccaaagtagctggagcagtacatcttcaatttttgacaagaaagcaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatgggaagacttttatgtggtttttactcactcttcatctcagacatcaacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactttattacctaaggctaaacctaaaatttttaagcaaaattagaaaaatagtcttcactcatcaaaaaataaagtttgttacatttagtattttcccaataaaattggtcgttcttggttttttatttggagagtctgtgcaaaatgtcactaaaaataaattagcactagaaattatttctaaatacc

SEQ ID NO: 328500 - DNA, 805 bp, Homo sapiens
gaagctgagactgcacttcctgcgaggcccctgcagcagcagcggcgtggtcagagcgagcttcggagaagcagtggtgggttccatgtgatggtggagtaggaggcaggtctccgcgctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagctggttggtggagaatttgaactggagatgaactctattatccaggatgctgagagtataat

SEQ ID NO: 328501 - DNA, 4767 bp, Homo sapiens
  misc_feature (1621)..(1621): n is a, c, g, or t
gaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttggatagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccacctatagcacctttcaattacacacantcatccatgcatttatgaaaaacccataccctgggattgattccggagaacaacttgctgaagaaattggtgcttcagagtcaagagtccaaatttggttccaaaatcaaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacagtcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgatgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgacactgaaactaataattaggcaatgtcaagcaaatacaaattcaggttgacagtctgcaaagtaacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatacctgtaatcccatcactttgggaggccaagacaggttgattacttgaattcaggagttcaagaccagcctggacaacatggcaaaacacgtctttaaaaaaagaaaagaaaaaagaaaaacagaaagaaaaagaagaaaaactacttgctgcccttacttgaagctcaattatttaaaacaaagaaaaaatagaaaaatcttttattgctcaaaatgctaatgatcacctgagccttcagggagtcttagtctttttgctggtgaagggtcttgccttgatgttgttggctgctgcctgataagggcgatggttgctgaatattgaagtggttgtcacaatttcttaaaagaaaacaacgaaatttgccacattaactgactcttccttccacgaaagatttcagtgtaccatgcgatactgtttgataagcattttacccatagtagaacttctttcaaaattggagtcagtcctctcacaccctgccactgttttactatgtttatcaatattctaaatcctttgttgtaggctaaacaatattcacagcattttcaccaggagtaaatttcatctcacaaaaccactttccaggctctttctggactgtagagttctttccaggctaccttgtggcagtttaagagtctggcatcattttccgctgggacctaaggatcgaggaggtgcttgtgactagactgccaatggacccatcacaaagtttaacccaaccttgatccccgagtcttcacaaatgctcactgaagaaaattcctggaacaattcagggtcctttcataacctctactctgaggtgttaataaaaaaccttagtaacttaaaaaaaatgagctgtacacaaatactgaacaataatgctacatatgttaagtatgtaagaaaaatatatactttgacataaataagaaacggtgagttgataattggatagaatggtggatagagtgatagatatgtagtaaagcaaatataacaaaatgataattgtacaatctaagtggttggactataaatatgcacttcccacaacatttttatatgtttaaacagttttataataccatattagggaaactgtttgtctcaaggaaatagagattgtgatatgttctagtacaatgaagtgtaatcatgtaaaataaaagcttttacttctggcaattaaagttaatcatgttagaacactgtctaggaatggttggaaaatcatattttattttctaatcaatatatttatgtcatctgtcaatcagaattacactgactttaaaa

SEQ ID NO: 328502 - DNA, 4508 bp, Homo sapiens
  misc_feature (1362)..(1362): n is a, c, g, or t
gaagctgagactgcacttcctgcgaggcccctgcagcagcagcggcgtggtcagagcgagcttcggagaagcagtggtgggttccatgtgatggtggagtaggaggcaggtctccgcggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttggatagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccacctatagcacctttcaattacacacantcatccatgcatttatgaaaaacccataccctgggattgattccggagaacaacttgctgaagaaattggtgcttcagagtcaagagtccaaatttggttccaaaatcaaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacagtcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgatgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgacactgaaactaataattaggcaatgtcaagcaaatacaaattcaggttgacagtctgcaaagtaacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatacctgtaatcccatcactttgggaggccaagacaggttgattacttgaattcaggagttcaagaccagcctggacaacatggcaaaacacgtctttaaaaaaagaaaagaaaaaagaaaaacagaaagaaaaagaagaaaaactacttgctgcccttacttgaagctcaattatttaaaacaaagaaaaaatagaaaaatcttttattgctcaaaatgctaatgatcacctgagccttcagggagtcttagtctttttgctggtgaagggtcttgccttgatgttgttggctgctgcctgataagggcgatggttgctgaatattgaagtggttgtcacaatttcttaaaagaaaacaacgaaatttgccacattaactgactcttccttccacgaaagatttcagtgtaccatgcgatactgtttgataagcattttacccatagtagaacttctttcaaaattggagtcagtcctctcacaccctgccactgttttactatgtttatcaatattctaaatcctttgttgtaggctaaacaatattcacagcattttcaccaggagtaaatttcatctcacaaaaccactttccaggctctttctggactgtagagttctttccaggctaccttgtggcagtttaagagtctggcatcattttccgctgggacctaaggatcgaggaggtgcttgtgactagactgccaatggacccatcacaaagtttaacccaaccttgatccccgagtcttcacaaatgctcactgaagaaaattcctggaacaattcagggtcctttcataacctctactctgaggtgttaataaaaaaccttagtaacttaaaaaaaatgagctgtacacaaatactgaacaataatgctacatatgttaagtatgtaagaaaaatatatactttgacataaataagaaacggtgagttgataattggatagaatggtggatagagtgatagatatgtagtaaagcaaatataacaaaatgataattgtacaatctaagtggttggactataaatatgcacttcccacaacatttttatatgtttaaacagttttataataccatattagggaaactgtttgtctcaaggaaatagagattgtgatatgttctagtacaatgaagtgtaatcatgtaaaataaaagcttttacttctggcaattaaagttaatcatgttagaacactgtctaggaatggttggaaaatcatattttattttctaatcaatatatttatgtcatctgtcaatcagaattacactgactttaaaa

SEQ ID NO: 328503 - DNA, 4656 bp, Homo sapiens
  misc_feature (1510)..(1510): n is a, c, g, or t
gaagctgagactgcacttcctgcgaggcccctgcagcagcagcggcgtggtcagagcgagcttcggagaagcagtggtgggttccatgtgatggtggagtaggaggcaggtctccgcgctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttggatagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccacctatagcacctttcaattacacacantcatccatgcatttatgaaaaacccataccctgggattgattccggagaacaacttgctgaagaaattggtgcttcagagtcaagagtccaaatttggttccaaaatcaaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacagtcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgatgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgacactgaaactaataattaggcaatgtcaagcaaatacaaattcaggttgacagtctgcaaagtaacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatacctgtaatcccatcactttgggaggccaagacaggttgattacttgaattcaggagttcaagaccagcctggacaacatggcaaaacacgtctttaaaaaaagaaaagaaaaaagaaaaacagaaagaaaaagaagaaaaactacttgctgcccttacttgaagctcaattatttaaaacaaagaaaaaatagaaaaatcttttattgctcaaaatgctaatgatcacctgagccttcagggagtcttagtctttttgctggtgaagggtcttgccttgatgttgttggctgctgcctgataagggcgatggttgctgaatattgaagtggttgtcacaatttcttaaaagaaaacaacgaaatttgccacattaactgactcttccttccacgaaagatttcagtgtaccatgcgatactgtttgataagcattttacccatagtagaacttctttcaaaattggagtcagtcctctcacaccctgccactgttttactatgtttatcaatattctaaatcctttgttgtaggctaaacaatattcacagcattttcaccaggagtaaatttcatctcacaaaaccactttccaggctctttctggactgtagagttctttccaggctaccttgtggcagtttaagagtctggcatcattttccgctgggacctaaggatcgaggaggtgcttgtgactagactgccaatggacccatcacaaagtttaacccaaccttgatccccgagtcttcacaaatgctcactgaagaaaattcctggaacaattcagggtcctttcataacctctactctgaggtgttaataaaaaaccttagtaacttaaaaaaaatgagctgtacacaaatactgaacaataatgctacatatgttaagtatgtaagaaaaatatatactttgacataaataagaaacggtgagttgataattggatagaatggtggatagagtgatagatatgtagtaaagcaaatataacaaaatgataattgtacaatctaagtggttggactataaatatgcacttcccacaacatttttatatgtttaaacagttttataataccatattagggaaactgtttgtctcaaggaaatagagattgtgatatgttctagtacaatgaagtgtaatcatgtaaaataaaagcttttacttctggcaattaaagttaatcatgttagaacactgtctaggaatggttggaaaatcatattttattttctaatcaatatatttatgtcatctgtcaatcagaattacactgactttaaaa

SEQ ID NO: 328504 - DNA, 4122 bp, Homo sapiens
  misc_feature (976)..(976): n is a, c, g, or t
gaagctgagactgcacttcctgcgaggcccctgcagcagcagcggcgtggtcagagcgagcttcggagaagcagtggtgggttccatgtgatggtggagtaggaggcaggtctccgcggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttggatagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccacctatagcacctttcaattacacacantcatccatgcatttatgaaaaacccataccctgggattgattccggagaacaacttgctgaagaaattggtgcttcagagtcaagagtccaaatttggttccaaaatcaaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacagtcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgatgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgacactgaaactaataattaggcaatgtcaagcaaatacaaattcaggttgacagtctgcaaagtaacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatacctgtaatcccatcactttgggaggccaagacaggttgattacttgaattcaggagttcaagaccagcctggacaacatggcaaaacacgtctttaaaaaaagaaaagaaaaaagaaaaacagaaagaaaaagaagaaaaactacttgctgcccttacttgaagctcaattatttaaaacaaagaaaaaatagaaaaatcttttattgctcaaaatgctaatgatcacctgagccttcagggagtcttagtctttttgctggtgaagggtcttgccttgatgttgttggctgctgcctgataagggcgatggttgctgaatattgaagtggttgtcacaatttcttaaaagaaaacaacgaaatttgccacattaactgactcttccttccacgaaagatttcagtgtaccatgcgatactgtttgataagcattttacccatagtagaacttctttcaaaattggagtcagtcctctcacaccctgccactgttttactatgtttatcaatattctaaatcctttgttgtaggctaaacaatattcacagcattttcaccaggagtaaatttcatctcacaaaaccactttccaggctctttctggactgtagagttctttccaggctaccttgtggcagtttaagagtctggcatcattttccgctgggacctaaggatcgaggaggtgcttgtgactagactgccaatggacccatcacaaagtttaacccaaccttgatccccgagtcttcacaaatgctcactgaagaaaattcctggaacaattcagggtcctttcataacctctactctgaggtgttaataaaaaaccttagtaacttaaaaaaaatgagctgtacacaaatactgaacaataatgctacatatgttaagtatgtaagaaaaatatatactttgacataaataagaaacggtgagttgataattggatagaatggtggatagagtgatagatatgtagtaaagcaaatataacaaaatgataattgtacaatctaagtggttggactataaatatgcacttcccacaacatttttatatgtttaaacagttttataataccatattagggaaactgtttgtctcaaggaaatagagattgtgatatgttctagtacaatgaagtgtaatcatgtaaaataaaagcttttacttctggcaattaaagttaatcatgttagaacactgtctaggaatggttggaaaatcatattttattttctaatcaatatatttatgtcatctgtcaatcagaattacactgactttaaaa

SEQ ID NO: 328505 - DNA, 4320 bp, Homo sapiens
  misc_feature (1174)..(1174): n is a, c, g, or t
gagtgagatgtggcaatgtttttctttctctacctggttcaggtcatttaccatgctgtcctccaggttcaacagtatggctccaaatgatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttggatagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccacctatagcacctttcaattacacacantcatccatgcatttatgaaaaacccataccctgggattgattccggagaacaacttgctgaagaaattggtgcttcagagtcaagagtccaaatttggttccaaaatcaaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacagtcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgatgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgacactgaaactaataattaggcaatgtcaagcaaatacaaattcaggttgacagtctgcaaagtaacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggagcctgaggcaggaggatggtttcaacataggagatcgaggctgctgtgagctatgatcgtgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatacctgtaatcccatcactttgggaggccaagacaggttgattacttgaattcaggagttcaagaccagcctggacaacatggcaaaacacgtctttaaaaaaagaaaagaaaaaagaaaaacagaaagaaaaagaagaaaaactacttgctgcccttacttgaagctcaattatttaaaacaaagaaaaaatagaaaaatcttttattgctcaaaatgctaatgatcacctgagccttcagggagtcttagtctttttgctggtgaagggtcttgccttgatgttgttggctgctgcctgataagggcgatggttgctgaatattgaagtggttgtcacaatttcttaaaagaaaacaacgaaatttgccacattaactgactcttccttccacgaaagatttcagtgtaccatgcgatactgtttgataagcattttacccatagtagaacttctttcaaaattggagtcagtcctctcacaccctgccactgttttactatgtttatcaatattctaaatcctttgttgtaggctaaacaatattcacagcattttcaccaggagtaaatttcatctcacaaaaccactttccaggctctttctggactgtagagttctttccaggctaccttgtggcagtttaagagtctggcatcattttccgctgggacctaaggatcgaggaggtgcttgtgactagactgccaatggacccatcacaaagtttaacccaaccttgatccccgagtcttcacaaatgctcactgaagaaaattcctggaacaattcagggtcctttcataacctctactctgaggtgttaataaaaaaccttagtaacttaaaaaaaatgagctgtacacaaatactgaacaataatgctacatatgttaagtatgtaagaaaaatatatactttgacataaataagaaacggtgagttgataattggatagaatggtggatagagtgatagatatgtagtaaagcaaatataacaaaatgataattgtacaatctaagtggttggactataaatatgcacttcccacaacatttttatatgtttaaacagttttataataccatattagggaaactgtttgtctcaaggaaatagagattgtgatatgttctagtacaatgaagtgtaatcatgtaaaataaaagcttttacttctggcaattaaagttaatcatgttagaacactgtctaggaatggttggaaaatcatattttattttctaatcaatatatttatgtcatctgtcaatcagaattacactgactttaaaa

SEQ ID NO: 328506 - DNA, 1455 bp, Homo sapiens
gaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctctttgtgtatgtccaccacagttactttatcccttcatctgtggatgggcagtccagcctgggtgacaagagcaactccgtctccccaaaaaaaaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttattttta

SEQ ID NO: 328507 - DNA, 732 bp, Homo sapiens
tagtgccgcagtcttggatgatgggttcctagaagctctcaacatctcttcttaattggagaaagtgttaagccccaaagtagctggagcagtacatcttcaatttttgacaagaaagcaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatgggaagacttttatgtggtttttactcactcttcatctcagacatcaacagatgattacatcacttatttagctagtaaatttattaatataaaaactcagagacattccaatatccacattgcttacaccattaggcatagattcagtgtc

SEQ ID NO: 328508 - DNA, 385 bp, Homo sapiens
cctatttctgatccctgcccatgcctctgcttccttccaatctctggaaaccactgttgtgctctctagatctattgcaataaagccttttattttgggttctacatgagtgagatgtggcaatgtttttctttctctacctggttcaggtcatttaccatgctgtcctccaggttcaacagtatggctccaaatgatgaaatttcattctgattttctggctgaagactattctctttgtgtatgtccaccacagttactttatcccttcatctgtggatgggcaggtaagtttattccttatcttggcgattgtgaatagtgctgcagtccacataggatggctgatacctcttgcataaactgatttctttggcactgaaag

SEQ ID NO: 328509 - DNA, 564 bp, Homo sapiens
ttagtccatggctaaagctggtgatccaagacaagtggcaggtgaaggagcaagtcaactgaaaaggcagaagcaggtgggactcaaggtacaggagcagatttctacctcaaacagaaataggatggaaatgtccatgtgaccaagagacagagtttttattgggaaaaaaggacacaaggctgactagagaaatgaatgggattttggcagtattgaggctccatccaattgggtctggagagtatgaacttgctgtggcaccagtgtaagtggttgtgtttttctctggaaacacaagggttaaaaatggggagatcacacaggtggattaatcctggcttgttatctcctgtttgggtttatgaggagaacaatgaagggttagcaagaaagcagttgagaaataagactattaggtctttaacgtaataagaggagctagaaagaaagaaaactatgcttagagtgtgggatatttgagtttaagattttgaggttggttggagcagttctggctgatgacaaagttcagagtgtggccatggaggtgaattgccaagg

SEQ ID NO: 328510 - DNA, 441 bp, Homo sapiens
  misc_feature (31)..(31): n is a, c, g, or t
  misc_feature (34)..(34): n is a, c, g, or t
  misc_feature (50)..(50): n is a, c, g, or t
  misc_feature (60)..(60): n is a, c, g, or t
actcagcggcgcctttaatagttaagggtcntanaatgtttctttggaantttaaaaatntcagaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaac

SEQ ID NO: 328511 - DNA, 3754 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaattatgttatagcgagttacaagttgcaatttacatcttctataacacatgacttgattggtctaagttgccagaggtatcgggtaactggtcattgttttgttttgtttgttttattcttccttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaac

SEQ ID NO: 328512 - DNA, 675 bp, Homo sapiens
caggagtctgacaaatcgtgttgaatttgaacaaatagtaaaataattcctgcactgactttgcatgaaatgtgttatggtttggttttgttttttcttgagacagggtctcactctgtcacccagtatggagtgcagtggtgcaatcttggctcactgcatcgtctgcctcccaggctcaaacaatcctcccatctctgcctgccaagtagctgggactacaggtgcacaccaccatgcctggctaatttttgtattttttgtagagacggggtttcaccatgttgcccgggctagtcttgaactcctgggctcaagcgatcctccgtcctcaacctcccaaagtgctgggattacaggcatgagccactgcgctcggccatatttatattcgacatcatctctccatgtgcaagacgtggaggaaggagtcttatggcagctaaccctgaagcctctgtgagttaaaatatcgttttgttctttcccggcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtaagtgttcctctttggctcagaagttgtctagaca

SEQ ID NO: 328513 - DNA, 3808 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttccttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaac

SEQ ID NO: 328514 - DNA, 3754 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcttatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttccttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaac

SEQ ID NO: 328515 - DNA, 3474 bp, Homo sapiens
  misc_feature (44)..(44): n is a, c, g, or t
  misc_feature (51)..(51): n is a, c, g, or t
  misc_feature (57)..(57): n is a, c, g, or t
  misc_feature (59)..(59): n is a, c, g, or t
cccaagttggaatccccctattggataatctccaacctgtgtgntttgtcntaacantntcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttccttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaac

SEQ ID NO: 328516 - DNA, 845 bp, Homo sapiens
ggcactcgtgcctcagccccactgtagcccttgatttcctgcctgaatggtacagtgagttggcgctgggattcctggccctgccctcctttgccttctctgtccccacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttcaggactaga

SEQ ID NO: 328517 - DNA, 727 bp, Homo sapiens
ccctggcctcgctccattccccacttttaacggtcactcggccttaagccgtcctgggtgtatgtgaggctgaaagggaaggaggaacagggtctgggccgctgtgtgctctgccgtcatctctaagaaacaaccataccactgaatgctactgtgtacttacaaaccacactcatattcgtcacgtcatttcatcttcacccccacctccaaatgaggtaagcagatattatgcctatttcatgaatgaggttactgaggcccagagaagtgacttgcccaaggtgactcaaatagtaaatggcagagatgaaactcaaaggcagggctgattattccaaggtccttgctgccacagatacacttctttgactctaggagttcacaaacgaagtgaggagacaggaggctaggggcagaatgtgtgcattctggaggtagagggggtggtctctcctgcaggcagaaggcagaggcagggttagaaaaccacaccccttcggggggactgtggcagactgatacttgggacatccaatggaggcctgtgaggtcaggggcggggctagctccagggggggccccaggagccccaacagtagttcagagcatgcggtgtcctggaagaagctacaagcggtgagtgatagcctctctccagctgaggccttcttcccatcacaactctttctgtctcctccctgccaacctagagccctctccctga

SEQ ID NO: 328518 - DNA, 2080 bp, Homo sapiens
ccctggcctcgctccattccccacttttaacggtcactcggccttaagccgtcctgggtgtatgtgaggctgaaagggaaggaggaacagggtctgggccgctgtgtgctctgccgtcatctctaagaaacaaccataccactgaatgctactgtgtacttacaaaccacactcatattcgtcacgtcatttcatcttcacccccacctccaaatgaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttcaggactaga

SEQ ID NO: 328519 - DNA, 2456 bp, Homo sapiens
ccctggcctcgctccattccccacttttaacggtcactcggccttaagccgtcctgggtgtatgtgaggctgaaagggaaggaggaacagggtctgggccgctgtgtgctctgccgtcatctctaagaaacaaccataccactgaatgctactgtgtacttacaaaccacactcatattcgtcacgtcatttcatcttcacccccacctccaaatgagtgccggcgttgactgggttttgtggtgatccttgtctggaatgaagaaagcctggcttgcgcagaggtgtttccctgcagaggggcttggagaagcagaagtggcagtatctgctatcttttacgtcagagactgccaactggcagacttcccgcacgcctgtcttaaacccactactagatatttctgttaactgactggcccttgctctttaagtcctgaatttggtctgatttccattctctcgccaccatgcctacctgctatgattctggataagctccaatcctctcttgggttactttatttgctcactcaggacagagggctctgatctaggaccagcaactcacaccctctcccctcacatccacaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttcaggactaga

SEQ ID NO: 328520 - DNA, 168 bp, Homo sapiens
agagaagatggcttttcctaagataatatattggtagtttttcataggtaactgaaaaacttggggcagctcaagtgctattaaggattgaagtaattaatgaataaatcgcagaaactatatcttcttattttgtgcttatagtaaacataaagtctgttggagaag

SEQ ID NO: 328521 - DNA, 452 bp, Homo sapiens
tactagaaaaaaaatgtaggagaaatgcttcaagacattgatctgcacaaagattttatggagaagacttcaaaagcataggcaacaaaagcaaaattacacaattagacatcacgagattatatcaaactaaaaagcttctgcacagcaaaggaaacaatcaacagagggaaaagagtacagaatgggagaaatatatgtaagctattcatccaataagggattaatatccagaacatgcagggagctcaaacaacagcaaaaaacaaaaaactcccccccaaaacacaaaacaacaaataatctgatttaaacataaacaaaatgagctgaataagtatctctcaaaagaagacatagaaatggctaacaggtatatgaaaaatgctcaacatcactaatcatcagggaaatgcaaatcaaaaccacaatgaaatatcatcttaccctag

SEQ ID NO: 328522 - DNA, 7403 bp, Homo sapiens
gccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaaaagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatggttgctcacctgaagaccacagcgggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttcttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacaca

SEQ ID NO: 328523 - DNA, 7020 bp, Homo sapiens
gttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaatagtggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaaaagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatggttgctcacctgaagaccacagcgggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttcttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacaca

SEQ ID NO: 328524 - DNA, 385 bp, Homo sapiens
ggttgctcacctgaagaccacagcgggcccacacacagtcattcaaacagccgtaagtcttatttctctttggattgttgtttttgtagttttgtaaccagaaacaaaatgagatgttctgttcaggagctctgggtaactcatctggttccttcttcctctagctttttttctgattagtatagatgaggagaggaactagaatttgggtaattaattttctttggtcgttggtaggaggcagtgtgtaaatgtgaataacatgcttttggagcccgatagactggtattataaaatattagttttgctagtttgtaggtatttaaccttgggcaaatctttaatctctctgaacctcagattctttacctatgaaatgaggaa

SEQ ID NO: 328525 - DNA, 7077 bp, Homo sapiens
gttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaatagtggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaaaagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatggttgctcacctgaagaccacagcgggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttcttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacaca

SEQ ID NO: 328526 - DNA, 6760 bp, Homo sapiens
gttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaatagtggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaaaagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatggttgctcacctgaagaccacagcgggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttcttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaatt

SEQ ID NO: 328527 - DNA, 255 bp, Homo sapiens
aatgccatccagggtctagctttttataagcaaagagtcctgaaagactgacttccatcattaccatattttggacagaagctgatttccctgggctgaagacattttgcaagttggaggagtatttgcatgacaagcaacaggagtttttggacatctggaggcttagttccaacgtgaccttaactgtgccctcaatgccacattcatctgctcagtctagtctgcaaatgatcctcttctgtggaccactga

SEQ ID NO: 328528 - DNA, 407 bp, Homo sapiens
cgcctcactgcctgtccccagagccctctgagctgactcatcctccctgcctagcaggcttcacttcacttcctcaatctccctgttctggccaagttgagaggactcccttcctgcaaaaatgtgttctaaggttagctcatggtttttgccgtattaatctctatgccagaactgttatttattaattttttctttaagtttcctcactttttaacttaaattatttaggaaggaaactttgtccttaccatgaatggaaaacaatatcaattgctgtatatagaaagtacacactgaaataaacatatagtcatctactgccgtaaaagatgttcatctgtagagcacccacaatcctctggccaccaccagcttgtggctcccccttccctgcctgttccctc

SEQ ID NO: 328529 - DNA, 365 bp, Homo sapiens
atccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaat

SEQ ID NO: 328530 - DNA, 246 bp, Homo sapiens
ccttcccagcctctggtatcaatcattctaggagagttgcctcgtctgatactcacgggtttgataaaccagttttcctgaagaagaaactggggttccaatgccactctttccacaaacaaccaagagccctccaggcactaacttgctcagagttctggtactgcagctcggcctcccaaagtgctgggattataggcgtgagccactgcacccggcctggacctggtgagtctggaagacctg

SEQ ID NO: 328531 - DNA, 277 bp, Homo sapiens
cttccaactgccaacatactaatacacaatacttggcagagctgtccaaagcaagtcagaccacatacagtatacctaaatcctgacacctccaactctcttaacaaataattttttttctccgtggtaatggtctcttggaagttaaaatatagtgagaaatgtgtaaacataccaatatattaaaataagacaagtgaatccctttaagaatcatgaaaaataattaacaacaacaacaaaagaaaaaaacagcaggaggcccagtgaggtggtt

SEQ ID NO: 328532 - DNA, 474 bp, Homo sapiens
tttcaagaagcctaacaaatcccaagcaggataaataaaatctctaatctagatacatcaaagacaaacttcagaccagagacaaagagaaaaatcataaagatagctagagaaacattagaataccttcaaagatacaatagttagattgacagttgacttctcaacaacagtggaagccagtagagtgctatcttgaatgttgatgaaggacaataactgcctacctaggattctaaacccagtgaaaatatatgtcagaatgagggctaattaaagacattttcaatcaaaagagagttttctgtcagcacatcttattgaaggaaattctaaataatgtatttcagatggaaggaaagtgatctcagatggaaagtctgaaaagcagaaagaaatgaagaacaaaaaaagtggtaaagatgtgaaaagactagtcacagggagaagacattgctatatatatttaatagc

SEQ ID NO: 328533 - DNA, 554 bp, Homo sapiens
cattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagg

SEQ ID NO: 328534 - DNA, 359 bp, Homo sapiens
tactgctcttttagaaaaaccattctcagtgtactgggatacggtactagtttgagaggctttttaaaagttaaaactctgggagcagctgatgttgctatggcctttatcttgccacactgacccacatgggacaatcatctcagcctgggcagaggagacatgcatagctggctccggggaaagcctaaactggcagcaggataggctgcctcctccaaggacctaattcctagataggctgtctttttttttcttcagtagagacaaagtctggctatgtggcctaggctgctctcgaatttctcagctcgagcaatcctccggcctcagcctcccagagtacaaccggccggtgg

SEQ ID NO: 328535 - DNA, 173 bp, Homo sapiens
agtgcccacccccactgctgctctgctggaagcatagccctgccaccattgcattgaactgtaccactgccgctgagcaaagtcaggatccccaactctgaccattgtatcatgcccggctggctctgcaatgtcattttgatgtgtcttcagtatggatttttttttttttt

SEQ ID NO: 328536 - DNA, 3480 bp, Homo sapiens
  misc_feature (1045)..(1045): n is a, c, g, or t
tacgagggcaggataaatgaaacattctgtctccaatctaagttcggcttggggcctcagaatatgaaggtaaaggggcggggacggactgactgcccctgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgccgattcagcgaagccccagcagccccgcggggcaggcgaggatcacatgcagctcggagaagaggaggcacttgcccctctgcctgagctgggaggtggtggccagctgcacacagggctgtcccaggatgctgacgaggcgggaccagccacaggccggcagcgctgcactgtgactccctttcacggggcccagccttgtctctggccttccgggactgagtcaggaggcgagggctacgttgctgccccagcacagtcgggccaggtgtggggaaaggcgggagggaggtgtgctgtgctctgagcagcctggcaggccctggagaggcaggaagccactgcaaacttcagaaactgggtgctgcttcctctcggtgaagttgtgttttgctaatctctgataatcaggtcagggatacagaaggaagagttgnccctgggtggctgctgtctttagacttgtcgggctccctctggtacagaagtgcctctcggattttgctgcctggtcttctctcttatggacatggagtagctctcaggctcttatggtacagctctaagaaggaacacttcttgcattgtctagtgaagtttctgggtttatggaagggaaactgacaaactggagccggcacagatggacactgggtaaagagaatgcagcctgtccctggctgcagtgccaggtgtggcctttcctgtgacagcaagtcacgtgctgtggctccagcttcataggaaggctcttgtctgtcaggcagtggagttacttacagacaagagccttgctcaggccagccctgcccctgcctacaggcacaggtgctttgccatctgtcccgttttcctgcttagggaaccaagatggtcagaaagttgcttgactctaacctaaatatttctgccgcttttgcgagtcagactctttttcttttccttgttcatggaaatggatcaaggagtaggagttttagatagctagggaggtggtgagaagttccgtctccacctgtaatttacaagtcgtgtcttaggtttccagcctctttcctctgttctgggtatctcgtgctctccaccctttagggattttggtgtggtgggtccgtggcaagacactcgatccagacacacgcatttccgaggcacttccatgtcacttaccaagcctccttgtgtgtggatatcacttcactggctccctcaggctgcagccctgacccccaaggtagtgatggcagctggtgcatgaggtttgatttggaagtagccaggcaagccctggttgcaaaaaatacctcttctattccgacagcgggccagaggccgctgccattagacgcatccctctacttacccccgatcacttttcatggtcaggccggccttgcacaagcaggttctgttcactgcgcacccccatttcttagatggggtactgagcactgcttttcccttagctcacttcatgtggcagcttctcagggatgggacctaccatggctgtgggagatgctttgctactacttactacctttccgagggaggagggctcatttttagaaatgttactggggagccaaattgtaggcctccgaccagagggcctcgctctctccatctcccaggaaccaagggtagctctggctctctgaggagctgtctccagcctccaggtggacgtcctttccagcataccagggcttatggaggcaaaatgaaagctggtccacgtgggaactccctactgttgtcctttccttgggcagacaccatatactttttagctcctagcagtgtttatcccgttttccccaaagcatccttggactcaggcctttcatcctggacccatctgtctggcctgttgtgctgagcctttggtctaagtggttggttggtcccagccacttcttcaaaagaaggtttcctgaggtaaccataaattagggcaatcgtacttccaggaacagtgaggctgatgggcctgttcccaagggtactttggcagggggtgctggggaaggggctggcctagggcaggtttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgttcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacaaaaaaaaaaaa

SEQ ID NO: 328537 - DNA, 437 bp, Homo sapiens
aggctacgttaaaggaatatggtagccatcatctgggaggtaaaaaacctatggaaattggcacctggggaactcaggaaagctgaaagcaccttgaaatgagatggaaggaccagaaggttaaggctggtgaagaggagacctggagagaacgtgggcactcctgccagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacaaaaaaaaaaaa

SEQ ID NO: 328538 - DNA, 3426 bp, Homo sapiens
  misc_feature (1045)..(1045): n is a, c, g, or t
tacgagggcaggataaatgaaacattctgtctccaatctaagttcggcttggggcctcagaatatgaaggtaaaggggcggggacggactgactgcccctgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgccgattcagcgaagccccagcagccccgcggggcaggcgaggatcacatgcagctcggagaagaggaggcacttgcccctctgcctgagctgggaggtggtggccagctgcacacagggctgtcccaggatgctgacgaggcgggaccagccacaggccggcagcgctgcactgtgactccctttcacggggcccagccttgtctctggccttccgggactgagtcaggaggcgagggctacgttgctgccccagcacagtcgggccaggtgtggggaaaggcgggagggaggtgtgctgtgctctgagcagcctggcaggccctggagaggcaggaagccactgcaaacttcagaaactgggtgctgcttcctctcggtgaagttgtgttttgctaatctctgataatcaggtcagggatacagaaggaagagttgnccctgggtggctgctgtctttagacttgtcgggctccctctggtacagaagtgcctctcggattttgctgcctggtcttctctcttatggacatggagtagctctcaggctcttatggtacagctctaagaaggaacacttcttgcattgtctagtgaagtttctgggtttatggaagggaaactgacaaactggagccggcacagatggacactgggtaaagagaatgcagcctgtccctggctgcagtgccaggtgtggcctttcctgtgacagcaagtcacgtgctgtggctccagcttcataggaaggctcttgtctgtcaggcagtggagttacttacagacaagagccttgctcaggccagccctgcccctgcctacaggcacaggtgctttgccatctgtcccgttttcctgcttagggaaccaagatggtcagaaagttgcttgactctaacctaaatatttctgccgcttttgcgagtcagactctttttcttttccttgttcatggaaatggatcaaggagtaggagttttagatagctagggaggtggtgagaagttccgtctccacctgtaatttacaagtcgtgtcttaggtttccagcctctttcctctgttctgggtatctcgtgctctccaccctttagggattttggtgtggtgggtccgtggcaagacactcgatccagacacacgcatttccgaggcacttccatgtcacttaccaagcctccttgtgtgtggatatcacttcactggctccctcaggctgcagccctgacccccaaggtagtgatggcagctggtgcatgaggtttgatttggaagtagccaggcaagccctggttgcaaaaaatacctcttctattccgacagcgggccagaggccgctgccattagacgcatccctctacttacccccgatcacttttcatggtcaggccggccttgcacaagcaggttctgttcactgcgcacccccatttcttagatggggtactgagcactgcttttcccttagctcacttcatgtggcagcttctcagggatgggacctaccatggctgtgggagatgctttgctactacttactacctttccgagggaggagggctcatttttagaaatgttactggggagccaaattgtaggcctccgaccagagggcctcgctctctccatctcccaggaaccaagggtagctctggctctctgaggagctgtctccagcctccaggtggacgtcctttccagcataccagggcttatggaggcaaaatgaaagctggtccacgtgggaactccctactgttgtcctttccttgggcagacaccatatactttttagctcctagcagtgtttatcccgttttccccaaagcatccttggactcaggcctttcatcctggacccatctgtctggcctgttgtgctgagcctttggtctaagtggttggttggtcccagccacttcttcagtgaggctgatgggcctgttcccaagggtactttggcagggggtgctggggaaggggctggcctagggcaggtttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgttcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacaaaaaaaaaaaa

SEQ ID NO: 328539 - DNA, 3426 bp, Homo sapiens
  misc_feature (1045)..(1045): n is a, c, g, or t
tacgagggcaggataaatgaaacattctgtctccaatctaagttcggcttggggcctcagaatatgaaggtaaaggggcggggacggactgactgcccctgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgccgattcagcgaagccccagcagccccgcggggcaggcgaggatcacatgcagctcggagaagaggaggcacttgcccctctgcctgagctgggaggtggtggccagctgcacacagggctgtcccaggatgctgacgaggcgggaccagccacaggccggcagcgctgcactgtgactccctttcacggggcccagccttgtctctggccttccgggactgagtcaggaggcgagggctacgttgctgccccagcacagtcgggccaggtgtggggaaaggcgggagggaggtgtgctgtgctctgagcagcctggcaggccctggagaggcaggaagccactgcaaacttcagaaactgggtgctgcttcctctcggtgaagttgtgttttgctaatctctgataatcaggtcagggatacagaaggaagagttgnccctgggtggctgctgtctttagacttgtcgggctccctctggtacagaagtgcctctcggattttgctgcctggtcttctctcttatggacatggagtagctctcaggctcttatggtacagctctaagaaggaacacttcttgcattgtctagtgaagtttctgggtttatggaagggaaactgacaaactggagccggcacagatggacactgggtaaagagaatgcagcctgtccctggctgcagtgccaggtgtggcctttcctgtgacagcaagtcacgtgctgtggctccagcttcataggaaggctcttgtctgtcaggcagtggagttacttacagacaagagccttgctcaggccagccctgcccctgcctacaggcacaggtgctttgccatctgtcccgttttcctgcttagggaaccaagatggtcagaaagttgcttgactctaacctaaatatttctgccgcttttgcgagtcagactctttttcttttccttgttcatggaaatggatcaaggagtaggagttttagatagctagggaggtggtgagaagttccgtctccacctgtaatttacaagtcgtgtcttaggtttccagcctctttcctctgttctgggtatctcgtgctctccaccctttagggattttggtgtggtgggtccgtggcaagacactcgatccagacacacgcatttccgaggcacttccatgtcacttaccaagcctccttgtgtgtggatatcacttcactggctccctcaggctgcagccctgacccccaaggtagtgatggcagctggtgcatgaggtttgatttggaagtagccaggcaagccctggttgcaaaaaatacctcttctattccgacagcgggccagaggccgctgccattagacgcatccctctacttacccccgatcacttttcatggtcaggccggccttgcacaagcaggttctgttcactgcgcacccccatttcttagatggggtactgagcactgcttttcccttagctcacttcatgtggcagcttctcagggatgggacctaccatggctgtgggagatgctttgctactacttactacctttccgagggaggagggctcatttttagaaatgttactggggagccaaattgtaggcctccgaccagagggcctcgctctctccatctcccaggaaccaagggtagctctggctctctgaggagctgtctccagcctccaggtggacgtcctttccagcataccagggcttatggaggcaacaccatatactttttagctcctagcagtgtttatcccgttttccccaaagcatccttggactcaggcctttcatcctggacccatctgtctggcctgttgtgctgagcctttggtctaagtggttggttggtcccagccacttcttcaaaagaaggtttcctgaggtaaccataaattagggcaatcgtacttccaggaacagtgaggctgatgggcctgttcccaagggtactttggcagggggtgctggggaaggggctggcctagggcaggtttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgttcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacaaaaaaaaaaaa

SEQ ID NO: 328540 - DNA, 320 bp, Homo sapiens
aaaaacctaattatccaaatgaaactatacgtcaagagctactttatgcatataattgagaaagtataatatcgggtctcttccttcaaaaagactgaatgcttgaagcaatttgaggataccagtccacaaggggttttacaacaaaagggcacatcttgctcaagttcagccctctggcttaaaccccatggtgcatatgcagtctttatcagagctccctggcctacacagcacctttctgggaagtagaaaaggcatgacccaaggaacagccccatggtggcagggcatgagcctttgtgggccaaaaaagtcag

SEQ ID NO: 328541 - DNA, 394 bp, Homo sapiens
gggtgcatgggagcacctgctctcccgtctccctccttgaagcagctcggcagcaagagccatgtctgtagagtcccagtatctaggctctcaaaatggcaccctgctgaggctgctccaggttcagatgcatgtgagattttgtattggtttcctttctggagcaatgcctctgtgcaatgtttaggcagctccgaatgtcaggcccaggccctggcccagtgggtcgaggtttccttccgtggccaagattataaaagtttgttttggagccctagggggttctctcttactgtttccccacatcaggagcctctcccgactctcagtcggttcccagctgggcaagctgcctcgaatcctctccttacttctcatgtttcccatatctttt

SEQ ID NO: 328542 - DNA, 327 bp, Homo sapiens
gtgggggaggggagactgcagagggcagggagctgggcaaggtccagacataacaaaggctgaacgatgaagatgaagaagggggctgtttcaactaatcaggaattggcgatgggttgtgaatcaggacctaccaagccctggagtaaaggcaggaatcaaacaagctacagctggacgctgatgattgtgaagttctgcacgaggctacaaaaagcctgttgcccaaggctgggctgctgggacacgtggctcagctgagctgtgtggggagcacgtgaggctgggtcagctatgagctcagccaagtggtcccccaccaaaact

SEQ ID NO: 328543 - DNA, 589 bp, Homo sapiens
caagttcaatataatgacaacactagttagagttttcaagcactttctccgataagcactttatatgcattgtgtcatttaacaattgcattgactttatgaagtagacatgattatacccattttcataaagaagaaactgaagcacaaggtcaaacaatgagtaaaaagccaactcaatactgcagtccaacttatagaattaagttgccttctagcttggattctgggagagagttgataaagggcactattaaatgaccatcacacatctcttctagtaccagtgtggctattcaatggcttaaccagttctggcactgaaacgactgggcaaaaatcagaccatttgagtttagtccctgtccaggtctcagaacccacattaatctccccactgtcactactccactgcctagaaagactcctatcctttctggtatcctcatatcagagaggttcttatcatccatgttctcacttggaattcctcaccatagaccacaatcactcttgctttgccactggaactgttcatttatttctaacagtttctactatatcctcccaatgttggtggagggatctt

SEQ ID NO: 328544 - DNA, 437 bp, Homo sapiens
tatacttggttctaattagtggttgtttattagaattaatagtatttacagggaagaaagctcttaaagttagatgtttaatatgtggctttttttttcattttgcttacattaaacataattatagttggcattcatttgcatttttattttgcagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgacaaaatactgcagcgcttggagcggttacgcttccttcagctagagcaggaacatacgtgtcctcaggaaggacgcgctgaacgcttaagggggcagcccctgaaggtactgtagtttcagaggttaatgaagcaagaa

SEQ ID NO: 328545 - DNA, 4164 bp, Homo sapiens
gactgagtctcaccatgtaggtcaggctggtcttaaactcccgaactcagagataatccacctgcctccacctcccaaagtgccgggattaaaggcgtgagccaacgcgcacggcctcctggggtgctgggattacaggcgtgagccacggcgcctggccttcttattgtactttctaaatttccccatagtctgcatgtatgacttttataatcataaagtgaaaaataaaatgcctttttaaaaattaattgaagtttgagaacatcgtgtcatttgttttaaatgacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaaaaaaaaaaa

SEQ ID NO: 328546 - DNA, 3710 bp, Homo sapiens
caaacagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaaaaaaaaaaa

SEQ ID NO: 328547 - DNA, 2331 bp, Homo sapiens
aagaacataagcaaaatacagctgataaaattctaccaaaagatcagatttttcaattttccctaaaaatagaaaaaatctcaatgcatgttccataaaaatacaaacaccatgacgcctctaggggttacaaaaatgtgaaaaatgcgcacaaagcaaacagaaaaactgaagagacagcaaaaagagaggaaaaacaagctggcagaactcagaaaaaaaatagaaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaaaaaaaaaaa

SEQ ID NO: 328548 - DNA, 196 bp, Homo sapiens
ataatgcttaaaataagagtgtgatttaaacccaaaattgagaatccaagttagaaaaccactggttatctgccttaaacagatagaagtgatacttggaaaataaacatcaggggatatggccaccttaattaagagagtgaggattatgattaccacaggtacttcatcaggtcttaattcattttcttgatag

SEQ ID NO: 328549 - DNA, 395 bp, Homo sapiens
gccgcatacgggtacaacgtgtctaaaggtacagaagcccagggtggctgcagactttgttctggtcagagacagtctagaaattctgtcagtcaggtagaacatgtaggaaaccctgaagccgggagctttcttcctagagccccaattggggttcttcttctttgtaataagcactgttgactcaccccttgccctcctgacggtacagggctgtctgtggattggaagtagttgtaaaaagggagagctgaattgtgaactgtactactttaaacattctgaatttttcttgctttggggatttgttttcttcctaggctttcatttctgagatccacattttagtaatccaaattagcatagttaacgttcattcagctgtgtgatttatc

SEQ ID NO: 328550 - DNA, 471 bp, Homo sapiens
gttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggtgagttctcaatcctcttggaatgtgttcctcgctttggcaaggggagaaccagggttatcttcatgtggtcctttcagatatttggaatttactgttcttgaggtttctgcttccttttttggccttagtaattcataggtaagaatattagtaatttatgatgagtggagagagaaatgtttttagatttgtgcttaaatacactcctttgacatgcttacagctgagaaagaaatgccact

SEQ ID NO: 328551 - DNA, 4044 bp, Homo sapiens
caaacagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaaaaaaaaaaa

SEQ ID NO: 328552 - DNA, 3810 bp, Homo sapiens
caaacagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaaaaaaaaaaa

SEQ ID NO: 328553 - DNA, 2056 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctgaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328554 - DNA, 1186 bp, Homo sapiens
  misc_feature (22)..(22): n is a, c, g, or t
  misc_feature (62)..(63): n is a, c, g, or t
  misc_feature (71)..(71): n is a, c, g, or t
  misc_feature (74)..(74): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (91)..(91): n is a, c, g, or t
  misc_feature (93)..(93): n is a, c, g, or t
cgaatccggaccaccctccagnctacccagcctcttagttgcccccccccccaccccccagnnggaggacnttnagngcccgcncnctcantnatatgagactgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328555 - DNA, 676 bp, Homo sapiens
ggagaccggggttcgtttccccgagggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328556 - DNA, 599 bp, Homo sapiens
caggtcatcctcccttgttttcactgcctcaggtgcccccaacactgccgagctcaagatctgccgagtgaaccgaaactctggcagctgcctcggtggggatgagatcttcctactgtgtgacaaggtgcagaaaggtatacatcaggaggcaggggtgggctcttgggagcaaggggtgaagctgagcagagaagtggagtgtcaggtaactggctttggatacttcctcctgtgcctcgggggcctcaggtgggccgaagggtgatgtatcagaagacaagcatcagaagttgagggggagaccatggagggttagacacactgacccacactgccaccgcatctcctgcagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacaggtacacagctggggtggcagcatcagggcag

SEQ ID NO: 328557 - DNA, 2627 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgaaaaaaaaaaagaacagacacacacaggcaaaacaacaaacaaccaaaagaggacaaacacgagagggcgagaagaac

SEQ ID NO: 328558 - DNA, 2970 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgaaaaaaaaaaaaaaaaaaaaaaaaaaaaaaaaaaaaaaaaaaaaaaaaaaacacgcgcgcggggggtttttgttggggggggggcgagaaaaaggggggagtgtgaggagagggaggcgcgccgcgcgggggcgcgcccacgggtgtgtgtttctccgcgcgcccacctttttttgtgtgtgtacaccagagcgggggatagaatcatggcgcggcggctccccccacactatagaggagggggcgcggctatatataatcttcataataagaacgccgggtgatataccgccgcgtcttttatgatacctgccgcgcagaaaaacaggatccaccacaagagccagagacagagcacacaagcaaccagcgaacacacgacggaccggataaccacggtgtcatatacaccagataatga

SEQ ID NO: 328559 - DNA, 2729 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgaaaaaaaaaaaaaaaaaaaaaaaaaaaaaaaaaaaaaaaaaaaaaaaaaaacatataaaaccattaaatcaatacaaaattttaactcatccaaaataaaacatgttcccaaattttattcccattatactttttttgccctttctgctcaccaactatttgtccttttcctcttttggc

SEQ ID NO: 328560 - DNA, 2522 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328561 - DNA, 2451 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328562 - DNA, 2281 bp, Homo sapiens
gcttggctgagtaccaaggggcgaagctaccatcaatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328563 - DNA, 2317 bp, Homo sapiens
ctgtgagatgatgataggcacggtggatgagatgggcacggaggtcttgtcagctgagtgaagggacagggttcgttgcagcacagtaggaagccactggagagggttaggcatggagcgatgatctaggggtgggcagagtaggaaggagcaggctgggcaaggcaggaaggtctgggctctgtgagagacagtgggacagacgactgggggcgctcagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328564 - DNA, 2643 bp, Homo sapiens
ctgtgagatgatgataggcacggtggatgagatgggcacggaggtcttgtcagctgagtgaagggacagggttcgttgcagcacagtaggaagccactggagagggttaggcatggagcgatgatctaggggtgggcagagtaggaaggagcaggctgggcaaggcaggaaggtctgggctctgtgagagacagtgggacagacgactgggggcgctcagtttccagaacctgggaatccagtgtgtgaagaagcgggacctggagcaggctatcagtcagcgcatccagaccaacaacaaccccttccaaggtgagggcaaacctgcctgccacacccgcaccctctgtcaccctccccagcccgcctttcctgcatctccctcactggccaagacacagtaaagctggaatcttggtgcccattcagtactctcccactttaccactgggaaactgagtcccaggaggggacatgacattcaggccacagtggagtcagtgctgggttctgcctcctctaggacttgtgtttcacacacgcaccagcggccctcccagcgcagagctccctgcccccactgatagcacctatatccccacttcccctgctctcctgatcgcctgttttcttggcagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328565 - DNA, 2535 bp, Homo sapiens
ctgtgagatgatgataggcacggtggatgagatgggcacggaggtcttgtcagctgagtgaagggacagggttcgttgcagcacagtaggaagccactggagagggttaggcatggagcgatgatctaggggtgggcagagtaggaaggagcaggctgggcaaggcaggaaggtctgggctctgtgagagacagtgggacagacgactgggggcgctcagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaaggtatacatcaggaggcaggggtgggctcttgggagcaaggggtgaagctgagcagagaagtggagtgtcaggtaactggctttggatacttcctcctgtgcctcgggggcctcaggtgggccgaagggtgatgtatcagaagacaagcatcagaagttgagggggagaccatggagggttagacacactgacccacactgccaccgcatctcctgcagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328566 - DNA, 1803 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccaggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328567 - DNA, 1990 bp, Homo sapiens
ctgtgagatgatgataggcacggtggatgagatgggcacggaggtcttgtcagctgagtgaagggacagggttcgttgcagcacagtaggaagccactggagagggttaggcatggagcgatgatctaggggtgggcagagtaggaaggagcaggctgggcaaggcaggaaggtctgggctctgtgagagacagtgggacagacgactgggggcgctcagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328568 - DNA, 1381 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccaggtaaggatttccttttgtcccactggaacgacaggttcagctctgttcagctgaggagcagtggagatgaagactcttgggccccattacagacctactgaatcagaggctttgaaaggatggcgcaggaaccagcgacttcctgggatgctaatgcacactgaagcctgggaaccaccgtgccacttaaattctatattgggtatcttgggaatcagaagttaaaaatgc

SEQ ID NO: 328569 - DNA, 1159 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggaaccacctgtccaacctgtggtacctcactattgtcgcaaccgcaatagcattcaagctcacgccgtgtccgctctccccgtg

SEQ ID NO: 328570 - DNA, 472 bp, Homo sapiens
aatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgctagagatccgctttttttcagcaaacactgagcacacattttgctagtcacatcaggccagacattggtggtagagagctgggtgaatgcgtgcactgtcctctg

SEQ ID NO: 328571 - DNA, 386 bp, Homo sapiens
gtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcc

SEQ ID NO: 328572 - DNA, 2431 bp, Homo sapiens
ggcacgaggcggggccgggtcgcagctgggcccgcggcatggacgaactgttccccctcatcttcccggcagagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328573 - DNA, 2180 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328574 - DNA, 884 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcctgcctgaatggatcctctagaacagccacacc

SEQ ID NO: 328575 - DNA, 2549 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328576 - DNA, 2767 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaaggtatacatcaggaggcaggggtgggctcttgggagcaaggggtgaagctgagcagagaagtggagtgtcaggtaactggctttggatacttcctcctgtgcctcgggggcctcaggtgggccgaagggtgatgtatcagaagacaagcatcagaagttgagggggagaccatggagggttagacacactgacccacactgccaccgcatctcctgcagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328577 - DNA, 2589 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgaataaaaaaaaaataattatatctttgactgtcgtatcga

SEQ ID NO: 328578 - DNA, 2550 bp, Homo sapiens
cgccggggccgcacggctgtgcggagccgcacgcgccgcgtttccgccccattcccgtcgacggagctgcgcagggagcggtcggcctgccggatggtggcgcggggcggggcaggcggggagggaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328579 - DNA, 2397 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328580 - DNA, 2404 bp, Homo sapiens
tgggggttcgattgtcaaagatgggagcaggctatcagtcagcgcatccagaccaacaacaaccccttccaaggtgagggcaaacctgcctgccacacccgcaccctctgtcaccctccccagcccgcctttcctgcatctccctcactggccaagacacagtaaagctggaatcttggtgcccattcagtactctcccactttaccactgggaaactgagtcccaggaggggacatgacattcaggccacagtggagtcagtgctgggttctgcctcctctaggacttgtgtttcacacacgcaccagcggccctcccagcgcagagctccctgcccccactgatagcacctatatccccacttcccctgctctcctgatcgcctgttttcttggcagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328581 - DNA, 2231 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328582 - DNA, 1979 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328583 - DNA, 2137 bp, Homo sapiens
agatggcggatggtcagggaatgcaggagaaagaacctagtttttgagggatgatgaggttgtctttgaattgatggaattgaagtgctttggagctactgaaataccactgtaattagaaagacagttctgaaagctctgactaaaatatgaaaccattagagataagaataagagtctctgctgaagtcttaaggcagttgtgcctcagctgccccagagtgccaagaaattctcgccaggcctgggtggaggctgacaatgagccaggatgtgagcagtgcaggaaggtgtgagctggaggctggggccccccaggtctcctctttgcccagagcatggcccctgtactcggcctcaccatgtggtcttagaggggcagattcagccaacagaggcctccaaaagctgtgggattctcagaactgctgagtgtcacacatcccttctcattggcagagaaggttgggagaatgggtcttgggaaagcctggctcctccccttcctcctgagggacctttgagagcgtcggggacccacctgaggagagcaagtcccacttctcccccttactttcccagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 328584 - DNA, 1210 bp, Homo sapiens
  misc_feature (1183)..(1183): n is a, c, g, or t
  misc_feature (1197)..(1197): n is a, c, g, or t
  misc_feature (1205)..(1205): n is a, c, g, or t
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctcatccgcttatccaatggggnaccgagcggaattngtaacggnttaaa

SEQ ID NO: 328585 - DNA, 1036 bp, Homo sapiens
cgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcctgcctgaatggatcctctagaacagccacacc

SEQ ID NO: 328586 - DNA, 519 bp, Homo sapiens
acgtgatctatttttcagaacagcaagtggatgggaaagaaccttgacaacacaaaactcatttactaatggactggttttgggtttctcttctctgagtccgcaaatctctctgcctgagccccaggcctattcagacctcgcggggagcggcgtcccccaggagcagttacgcgatctattggattaagcgggaggaaaaatgttggccggcccagtcacagcctccgaggaagagcacctcttttctgcccgggttcccgcaatcacaccttctacacgtcgtcttcccagatgacggcaatgtagtacgtcctggttccttttgaagacagataaaaagaaatgggcaggtaggtctggaggaagccgggaaaaaaaggtggtcctatttgtgtctaattgccatctctgctgtcatcctctgtaaatttatacctgcccttatttgtgcaggctatgcctcatttccttatacaaaattgttaattacaaagcacaccccatactcaaaaaaaa

SEQ ID NO: 328587 - DNA, 2748 bp, Homo sapiens
aaccaagttccccggcaactagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccaggtcagcaactggtttaagaaccggaggcaaagagaccgggccgcggaggccaaggaaagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcccccagtctgagttctggggcaattgatacgcctgtttcagcaggctttcttttttttcaatgaaggggaattgcaaatcaactggattttcattattcccttttaatttatatatggagaaatgtgaagagggaaaggaaatggaaagagaaagagaaagggagataaaaatagtgaaaataagagcctccaggctcagcaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggtttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaaaaaattggcttgctt

SEQ ID NO: 328588 - DNA, 2689 bp, Homo sapiens
aaccaagttccccggcaactagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcccccagtctgagttctggggcaattgatacgcctgtttcagcaggctttcttttttttcaatgaaggggaattgcaaatcaactggattttcattattcccttttaatttatatatggagaaatgtgaagagggaaaggaaatggaaagagaaagagaaagggagataaaaatagtgaaaataagagcctccaggctcagcaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggtttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaaaaaattggcttgctt

SEQ ID NO: 328589 - DNA, 3093 bp, Homo sapiens
acgtgatctatttttcagaacagcaagtggatgggaaagaaccttgacaacacaaaactcatttactaatggactggttttgggtttctcttctctgagtccgcaaatctctctgcctgagccccaggcctattcagacctcgcggggagcggcgtcccccaggagcaggtgggctgctgctccggcgccacgccggccatcggagccggagttcccaagggtcgagggcacccggagtttccgactaagcagaggaaaaagaattttggcacttcagccggatttggggagtctccgcactgccccagagcgatgacacgaatttattgaagaaacacctctctatgccctccctttccaaatatttgtaggtagagtagaatcctcaccgtcgttctggatggtgaaagaattccaagaaagcggcccgggagcccctaactatcttgctacaagccagaagggaaacaagtgggtcccagctaggggtgtttgcatcaaggcctgtcaacccagccgagaaaccctagcaacagctaatgctgtcccactgaatgctttttcatcgactaaagcgcacgcggccgttacctgcacagaggaggcactggagagccgaaacctggcatcgggcgctccttgccagcggtgttccctcccgagccgcgctgcagcgagggcagcagccggctggctagagttgctcatttcctttaaatctccaacgcatctctgcttttcgtgcgatttgcattgacagcaaaggttttatgttacgagaacaactcaaacctttctgtgtgcgatttaaaatggatcatttagtttaggtggtttgtaaattcatgtcattttacctctttcagcggttttcagtgaaaggttccattttgggaaaccttatatatccgagccaataattaacatttataacaattggttcccctaaccgagggatcgaaatagcaggtagactccttggtataaagcgcatagcactttccctttccagttacgcgatctattggattaagcgggaggaaaaatgttggccggcccagtcacagcctccgaggaagagcacctcttttctgcccgggttcccgcaatcacaccttctacacgtcgtcttcccagatgacggcaatgtagtacgtcctggttccttttgaagacagataaaaagaaatgggcagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcccccagtctgagttctggggcaattgatacgcctgtttcagcaggctttcttttttttcaatgaaggggaattgcaaatcaactggattttcattattcccttttaatttatatatggagaaatgtgaagagggaaaggaaatggaaagagaaagagaaagggagataaaaatagtgaaaataagagcctccaggctcagcaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggtttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaaaaaattggcttgctt

SEQ ID NO: 328590 - DNA, 2249 bp, Homo sapiens
acgtgatctatttttcagaacagcaagtggatgggaaagaaccttgacaacacaaaactcatttactaatggactggttttgggtttctcttctctgagtccgcaaatctctctgcctgagccccaggcctattcagacctcgcggggagcggcgtcccccaggagcagttacgcgatctattggattaagcgggaggaaaaatgttggccggcccagtcacagcctccgaggaagagcacctcttttctgcccgggttcccgcaatcacaccttctacacgtcgtcttcccagatgacggcaatgtagtacgtcctggttccttttgaagacagataaaaagaaatgggcagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcccccagtctgagttctggggcaattgatacgcctgtttcagcaggctttcttttttttcaatgaaggggaattgcaaatcaactggattttcattattcccttttaatttatatatggagaaatgtgaagagggaaaggaaatggaaagagaaagagaaagggagataaaaatagtgaaaataagagcctccaggctcagcaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggtttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaaaaaattggcttgctt

SEQ ID NO: 328591 - DNA, 2161 bp, Homo sapiens
aaccaagttccccggcaactagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccaggtcagcaactggtttaagaaccggaggcaaagagaccgggccgcggaggccaaggaaagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcccccagtctgagttctggggcaattgatacgcctgtttcagcaggctttcttttttttcaatgaaggggaattgcaaatcaactggattttcattattcccttttaatttatatatggagaaatgtgaagagggaaaggaaatggaaagagaaagagaaagggagataaaaatagtgaaaataagagcctccaggctcagcaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggtttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacacca

SEQ ID NO: 328592 - DNA, 1363 bp, Homo sapiens
acgtgatctatttttcagaacagcaagtggatgggaaagaaccttgacaacacaaaactcatttactaatggactggttttgggtttctcttctctgagtccgcaaatctctctgcctgagccccaggcctattcagacctcgcggggagcggcgtcccccaggagcaggtgggctgctgctccggcgccacgccggccatcggagccggagttcccaagggtcgagggcacccggagtttccgactaagcagaggaaaaagaattttggcacttcagccggatttggggagtctccgcactgccccagagcgatgacacgaatttattgaagaaacacctctctatgccctccctttccaaatatttgtaggtagagtagaatcctcaccgtcgttctggatggtgaaagaattccaagaaagcggcccgggagcccctaactatcttgctacaagccagaagggaaacaagtgggtcccagctaggggtgtttgcatcaaggcctgtcaacccagccgagaaaccctagcaacagctaatgctgtcccactgaatgctttttcatcgactaaagcgcacgcggccgttacctgcacagaggaggcactggagagccgaaacctggcatcgggcgctccttgccagcggtgttccctcccgagccgcgctgcagcgagggcagcagccggctggctagagttgctcatttcctttaaatctccaacgcatctctgcttttcgtgcgatttgcattgacagcaaaggttttatgttacgagaacaactcaaacctttctgtgtgcgatttaaaatggatcatttagtttaggtggtttgtaaattcatgtcattttacctctttcagcggttttcagtgaaaggttccattttgggaaaccttatatatccgagccaataattaacatttataacaattggttcccctaaccgagggatcgaaatagcaggtagactccttggtataaagcgcatagcactttccctttccagttacgcgatctattggattaagcgggaggaaaaatgttggccggcccagtcacagcctccgaggaagagcacctcttttctgcccgggttcccgcaatcacaccttctacacgtcgtcttcccagatgacggcaatgtagtacgtcctggttccttttgaagacagataaaaagaaatgggcaggtaggtctggaggaagccgggaaaaaaaggtggtcctatttgtgtctaattgccatctctgctgtcatcctctgtaaatttatacctgcccttatttgtgcaggctatgcctcatttccttatacaaaattgttaattacaaagcacaccccatactcaaaaaaaa

SEQ ID NO: 328593 - DNA, 438 bp, Homo sapiens
cctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacaggtgagcctagaggcaggggcggcggagcctgtggggcttttatt

SEQ ID NO: 328594 - DNA, 381 bp, Homo sapiens
gaatatgaaaaagtaaaaaaaaaaggtatccaatagactccaacgaaatgagtcagttacgtaaaaaaacaagattaatgacaatcaagaaacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcatgggtcacagtgagaccctgtctcaaataaataaataaaaattttaagagaaaaaaaaa

SEQ ID NO: 328595 - DNA, 5193 bp, Homo sapiens
gcgtgcctggtggctgcctgacaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328596 - DNA, 4550 bp, Homo sapiens
gcgtgcctggtggctgcctgacaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcatgggtcacagtgagaccctgtctcaaataaataaataaaaattttaagagaaaaaaaaa

SEQ ID NO: 328597 - DNA, 4838 bp, Homo sapiens
gcgtgcctggtggctgcctgacaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328598 - DNA, 3620 bp, Homo sapiens
aaacgttcccaggatccctaagcctccggccccagacaaacgggactcgcagcttctgcgcctcctgctccgctcactcttctttgtctcagcctttccatctttttcgccaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcccccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccaggggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328599 - DNA, 3357 bp, Homo sapiens
cgctggagtagtggtcctgactcgatcctcttttcgcattcagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328600 - DNA, 1680 bp, Homo sapiens
caggagtggaaggccgcagcagtttgaggcctgcgttcaggtctggacttccaggtcaagttctgagggtctatggcatctggctgaaatccttgcttcagggaagccgaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328601 - DNA, 1521 bp, Homo sapiens
gcgtgcctggtggctgcctgacaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctttggggttagggatgcaagagggaattattgacttcctttcatattgtggatggaggagttcccatattggaaggaatggtataagctggagacaggcggtctctgattgtggaattgattccatttctctgctggggaaagcta

SEQ ID NO: 328602 - DNA, 354 bp, Homo sapiens
gtcatgttcccacagaacgctaagcctggatgccccggttcagcctggtccatccctgtctgtcgcccggtgggatgtctggggcgggttggggaggggtggttgcttcagctcatcagttatgggggaatcactctttttcccttacatctcactaatgcttctctctctctcatctctccatccttagctaagcctggattcaaggtaagagatatctcgagatagggtctgggcaccttgacttctgggtctgatggagaagggagcttgagttccaaaatcctgggtctgaatgagaaggggattggggccagacagagtaactcatgcctgtaatctcagtattttggg

SEQ ID NO: 328603 - DNA, 357 bp, Homo sapiens
tatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttgcttaggagcatcattcaaatcacagatcccccagtatctagtcccaacctattgaatcaggatccccagggaaggaggagcttgggaatctgatttttttttttttttttagataaagtctcactctgtcacccaggcttgagtgcagt

SEQ ID NO: 328604 - DNA, 292 bp, Homo sapiens
tccgggtacgtggttggcagaggtggtccccgctggagtagtggtcctgactcgatcctcttttcgcattcagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctg

SEQ ID NO: 328605 - DNA, 6197 bp, Homo sapiens
cctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcccccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328606 - DNA, 4506 bp, Homo sapiens
tgggagctgggctcctgacatcactgtgtcctccccgcagagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328607 - DNA, 4023 bp, Homo sapiens
gcgtgcctggtggctgcctgacaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacacctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttggcagtgaaccgagattgcgccactagactccaagccctggagagacggaggccagcaagctggtcctccacacaacctacccatggaacctacccttcaattaaccaccacgcccgcaccccccaacgcacccccccagctcagacgcaccgccccacaccacaacgcggcacccagcccccacgcgcacaattccccactccccccgcgcgcccagccacacacaccggcccacccccgcccgacacaccaggccgaccgacgggggccccccacacgcgggggcaccacagg

SEQ ID NO: 328608 - DNA, 308 bp, Homo sapiens
ccagctaccatgctgatatgtttggcttgttctcctgtgcccactatagccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattccca

SEQ ID NO: 328609 - DNA, 621 bp, Homo sapiens
atagaaaagacaagagctcattcttcccctcagtgagctaatgaccaagttcaagaattgcaaataggattcatcttctaggccagttctgagcaattagagtgactccccatagtgttttgttgagaaggatttagaggcctaccttcagggatgcactatgtaattaatggtgcctgtcctgtgcaatggatgagagaatggtagcactgatgtcacgtgggaatgagtcctggttctcctggtccctttcctgcactacatggttattattatctctaaacattggtctaggccctatagactttgatttctagatctaatgcgtcaccaatcttataaagccttgggaaagccatattagtttaacataggggacatttggtgagccctgcccagtaacctgcattagacactgatgaaaaggaaagagaagtcaggcataggcactgtctttgaagctcatacatggagattcagatggacaaacaagaaaccataatgcaagtgtattacctcaagggtatggaccaagagttattgggaggtcaagccatggagtaagaagagaacagactttgcgtcagacgagcatgagtttgactgctaagccgtggcagg

SEQ ID NO: 328610 - DNA, 6698 bp, Homo sapiens
catttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcgtgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacataagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaatccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttccaaggcccgcacgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaaaaaaatgt

SEQ ID NO: 328611 - DNA, 6586 bp, Homo sapiens
catttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcgtgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacataagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaatccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttccaaggcccgcacgggttgatacgttttggttggttttttgttgttgtttttcttgcgtacaaagttggtcaaaaccatctttcaaagcaacagtgttttgtagtaccagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaaaaaaatgt

SEQ ID NO: 328612 - DNA, 5104 bp, Homo sapiens
catttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcgtgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacataagcagagagattttgaactgaggtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttccaaggcccgcacgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaaaaaaatgt

SEQ ID NO: 328613 - DNA, 4794 bp, Homo sapiens
catttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcgtgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacataagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaatccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcct

SEQ ID NO: 328614 - DNA, 3177 bp, Homo sapiens
tccaaaaaaaaaactagaaattaatgaattgaatattaaaaactaataagataaaaaaagtaaaatcaatatataacataaaactaaaacaaaataaaaacaaaagcataaataaagtcaaggaaaaacattagaaggataaataactctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttccaaggcccgcacgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaaaaaaatgt

SEQ ID NO: 328615 - DNA, 363 bp, Homo sapiens
tcaggaggtgatttgagctgttgatctggatttgggactcctcaggacaatctgtgaacaatgatgagagagagcaccaaggaccaaggtctgaacttgggagctagggcccatgtccacagggtgaactggaaggaagataaggagacagcaaggaatgcttgccaagaaaccaggagaccaggaaagagtagtttccaagagatgggggaagcccacactgttgcagggaggtcctgcataaagtctgaaacgggtctatttaattcgcccttggaggctgggcatggtgtctcacacctgtaatcccagcactttgggaggccaaggcgggtggatgacctgaggtcaagagtttgagaa

SEQ ID NO: 328616 - DNA, 293 bp, Homo sapiens
cttcaaagtgcctgtgtagaaaggaaatatgagacaaggtggtttgttttacttttctgtcaaatttcttctttagtagtttccaaaataaattcccaataataacagggcttttaacaagaaggtccattactaagagcaacctgcggtagaccgtcgtatgtctcacaactttacattctacacattccaataatcaagtcacatcaactctaattctctttcttgttcaggaacctgtactaccacttaacattctaaaacctgccacacccaatagtcaaacataatca

SEQ ID NO: 328617 - DNA, 353 bp, Homo sapiens
aagggggcgcggccgggacaagctgggggccggttatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtagtttgtatgcagctgcatct

SEQ ID NO: 328618 - DNA, 561 bp, Homo sapiens
actctagaggatacccttcgattgtgggatcagagtgactgtggccagccagggccctgcaggcagagttctggtaaggtgggtgctcagtgttggctcctccacctctacccggctctcccctcatctccagagctgggaggaaagaagagggcagcaggggggtccacggcgcgtgtgtgctggggcctgcacacatgtcccttcctgtggctgtgtgtccctcgctctctgcactcctggggagggggtgagtatcctgtgctctcccaaacccccgcacggcctgagttctctgactcatccacttcctccgcatgcctacactgggtgctcagccttcgtgggaacaagccgagggagccgagggaactgcaaggaggagaaagggcagagagggccccaggcagctcagcgctggctggcgctccttcctgggaggctgactgccggaagaaggcccagccctgttgaccccggttcacccagctctggtctgggggctaatcaaatgtgtcacctcctgcccacattctatagtggcagctcctgagttctcca

SEQ ID NO: 328619 - DNA, 3974 bp, Homo sapiens
acatcagtcggtaccagatcccctttcatccaccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328620 - DNA, 4622 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328621 - DNA, 4443 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328622 - DNA, 3163 bp, Homo sapiens
agaaagttccggctagtagggctgctgtgatcggccgagggctggaccctgcactttgcacgggcacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328623 - DNA, 4868 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtagtttgtatgcagctgcatct

SEQ ID NO: 328624 - DNA, 4706 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328625 - DNA, 2532 bp, Homo sapiens
actggaaaggtagaataggcaggggccctgccccacccatccacccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328626 - DNA, 4420 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaacgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328627 - DNA, 2011 bp, Homo sapiens
aatagctaggtacgaggctggttcatcgccgagacgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328628 - DNA, 5344 bp, Homo sapiens
  misc_feature (5344)..(5344): n is a, c, g, or t
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtaaaaaaaaaaaaaagaaaaaaaaaaaaaaaaaaaaggggggaataatgggggggggggaaaaaggggtacaggaaggggccaggggcccaaggggatcccggaccccagattccgtggccaagggggcaaacagacgggaacccaaaaggagacccgaaaaatcagaaagcccgggtaccggatagaagcggcggagaacaaagcaaccgcacgccaaagcccagacaccgacggccaccaaagggactcaacacagcaacagacgacacagactgcatcagaagaggcaatagccgaggagcgcagacgacaacgccgcgacacaccaaaacaaacaccaaaccacaaatacacagcaataaaccaagcacaaaaaagagagcagcgcacaacgaacagccagagagggacgcaccgcagcagagcgcagaacgagagcagggcacaacagagaaaaagagaaaccgcagacgagaaaaaaagaaagagagaaaagagcaaagaagaagaggaaaaggaacacgcagccacacaacgaaagcagaaaan

SEQ ID NO: 328629 - DNA, 4649 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagtgagcaagccaggccggcttgctcaggtctcctcgcttgctcaggtctcctggcttcctcaggtctgcctgcatttcttcaatcatgaattctgagtcctttgcttctttaaaacttgctccacacagtgtagtcaagccgactctccagacctggcaagccagg

SEQ ID NO: 328630 - DNA, 1303 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgtgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328631 - DNA, 3311 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggaggaatagggtagcccagccagttacccggactcgttcaaagtctctgtatcctcccttagccatgctg

SEQ ID NO: 328632 - DNA, 2987 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccagatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328633 - DNA, 1034 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggtggggaccatggggccatgggggaagaaaggaagagcagagaccacccacccctagttagccacggggacagctggcctagaccatccacactagaaacaggacctc

SEQ ID NO: 328634 - DNA, 379 bp, Homo sapiens
tgagtacagtagtggtagcccatcaagtggtagaggggaagggggcttagtccctggtggaaaggtgaggccagagtgcagttgtgactaatggcatttagttaaactagcacacacggattggccggcacctgtatgccaggccctgttccaagctcccaagatgcaaagttcttgacttcaggatgctcacagtccagtgtccaggcagaactgggccatggctgctggccatctggagtctactttcttgccctacttggaatagtgggatagaacatcatggtggggggcaagagagggaatagggagatgggtccagagtagaaagagacgaagttgactgggaccttggttgaacatcttccctctatcccag

SEQ ID NO: 328635 - DNA, 155 bp, Homo sapiens
atccccaccatcaacatggagaacaagaccacgtgggtgagtgcgcatgttcactaggacagcagtctccagccagagcttgagagtacagggcatcttttaagaggacactgacgcacttcagccatatggttctcaatcttggccacacggta

SEQ ID NO: 328636 - DNA, 102 bp, Homo sapiens
ggggcggggctcttggctgagtcctgggctcctgctctcaggctccagtacagcagagacgtccggaaattgctcctgagcatcaacgtgacgaacacccgg

SEQ ID NO: 328637 - DNA, 272 bp, Homo sapiens
gttggccaccttcggctattccctcagtgggcagatggatgtggatgagaacttctacccagaccttctagtgggaagcctgtcagaccacattgtgctgctgcggtgagccaggaggccagtgaataagggtctttctcttcttcatctttgtctgcacagattcccatctgtgtccatgtttgcgctagctccttggaagcctgggccccaactctggcctggggcaggcaggaggcactgatatctgtctggctctgttgtctctgcag

SEQ ID NO: 328638 - DNA, 520 bp, Homo sapiens
tgggtcagaggtctggcaggggggtaccgcagagagaatggcctggaggagatagaaggcttgttcacacggcttctagtcgcttcttgtccagctgggaagagggtgccctagaggagagtggggctggatgggattggtagagctcagaataatgacgagctggagaaggggagttgggagggctgccctgtgggtggagggcccaagcgggacccactcctgccctctggagactttgggcactgaagtatgggtgaggtgctctgattcatgatccttccggtgcccacagatgaccctggccatcacattattgaggacatgtggcttggagtgactgtggccagccagggccctgcaggcagagttctggtaaggtgggtgctcagtgttggctcctccacctctacccggctctcccctcatctccagagctgggaggaaagaagagggcagcaggggggtccacggcgcgtgtgtgctggggcctgcacacatgtcccttcctgtggctgtg

SEQ ID NO: 328639 - DNA, 4848 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328640 - DNA, 3605 bp, Homo sapiens
cctcagaaaatgcagctcaaagcgacgttgagtctgggaaactgatcattaagaagtccaaggatggttctgaggacaagttctacagccacaagaaactccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328641 - DNA, 4844 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgggcaagtgactgtgctttggcttacacccgagtgccgggaccccatctacggccgaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328642 - DNA, 4890 bp, Homo sapiens
  misc_feature (4850)..(4850): n is a, c, g, or t
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtaanaacaacacaaacggaggggcgctctatgatataccttcgg

SEQ ID NO: 328643 - DNA, 4813 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328644 - DNA, 2290 bp, Homo sapiens
gtgactccagcatccttcttacccctagggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328645 - DNA, 4945 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgagcatccagcacaggacctgacgcagaaatgaatgaacaaataaatgaatgatgcgcatttgtgtgtggaggggaggcctggctgacagatcctttggggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328646 - DNA, 4748 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctccccccttccatggtactgtagcaggggaattccctccccctccttgtgccttctttgtatataggcttctcacggcgaccaataaacagctcccagtttgta

SEQ ID NO: 328647 - DNA, 1679 bp, Homo sapiens
agtttaagcgggatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328648 - DNA, 1275 bp, Homo sapiens
tgcgagactcgtaagcaattgtactggaggtcttccctgatcctacccctcctgcccctgagtaccttcgtttgtatctccatacacctacattaagtaatggcccgctgacaatcgaccgtgtgctcaacaacttccggatggataagtcctggaggtccttgagcctggttctattacagtacgggaatcaataggacgatgttcgatttgacacctgaggctctgcccctgaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328649 - DNA, 3731 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 328650 - DNA, 1061 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggtggggaccatggggccatgggggaagaaaggaagagcagagaccacccacccctagttagccacggggacagctggcctagaccatccacactagaaacaggacctc

SEQ ID NO: 328651 - DNA, 1191 bp, Homo sapiens
aagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtaaggtgggtgctcagtgttggctcctccacctctacccggctctcccctcatctccagagctgggaggaaagaagagggcagcaggggggtccacggcgcgtgtgtgctggggcctgcacacatgtcccttcctgtggctgtgtgtccctcgctctctgcactcctggggagggggtgagtatcctgtgctctcccaaacccccgcacggcctgagttctctgactcatccacttcctccgcatgcctacactgggtgctcagccttcgtgggaacaagccgagggagccgagggaactgcaaggaggagaaagggcagagagggccccaggcagctcagcgctggctggcgctccttcctgggaggctgactgccggaagaaggcccagccctgttgaccccggttcacccagctctggtctgggggctaatcaaatgtgtcacctcctgcccacattctatagtggcagctcctgagttctcca

SEQ ID NO: 328652 - DNA, 366 bp, Homo sapiens
catcaacgtgacgaacacccggacctcggagcgctccggggaggacgcccacgaggcgctgctcaccctggtggtgcctcccgccctgctgctgtcctcagtgcgccccgtgagtgcccgccggccggctcagagcccaagcagggctccccgcgtctttgcatccccatatccatgtcctgtgcaggtgttgtcgtctgccacgtgcccacctcctctggtctgggccttcttgggggccttagcgtctctgctgcttggagaatccggctctcaagctctagggcttctgaccttgcaccacagaggagggaggacaagccctactttgacccgaccctgaccttattcgccttctttcctcag

SEQ ID NO: 328653 - DNA, 763 bp, Homo sapiens
tggggaatagatgcttggtaggcattaaatgttattcactctaaaagagatttgctagtgtccttttttaagatttataggtacatgttaatttaatacaacaacctgatgagcagagcatacaactcactcgtgtgtaatagttattgccccaccacttgtttgctgcacgtacccatgcaatttgaccaatgtttatgctatactagatcgtaaatatttctaatattactcatgccaataaatcaaatgacttcgtggtttattaaccaaattgaggcagttttgagagtcaaaagaagtgtgacattttaaaagctattattccagggcatcaagaataaaccgcaggattataaatcattctactacaaagacacatgcacacgtatgtttattgcggcactgttcacaatagcaaagacttggaaccaacccaaatggccatcagtgatagactgaataaagaaaatgtggcatatatacaccagggaatactatgcagccgtaaataaggatgagttcatgtcctttgcagggacatggatgaaactggaaaccatcattctcagtaaactaacacaaggacagaaaaccaaatatggcatgttctcactcataagtgggagttgaacaatgagaacacatggacacagggaggggaacatcacacaccagggcctgtttggcggcagggggctagagaagggctagcattaggagaaatacctaatgtatatgatggcttgatgggtgcagaaaa

SEQ ID NO: 328654 - DNA, 746 bp, Homo sapiens
ctgtagtctcagctactcaggaggctgaggcgggaggaccacttgagtccaggaggttgaggctgcagtgagccgtgatagtaccactgcactccagtctgggcaacagagtgagaccctatctcaaaaataaataagcaaataaaaataaaataggaactcagtgggtttaatggcagattagactcacttaaaaataaattagagacctgataaacaactgaaagatacatttgaagaaattagtcagaatttagcacaaacaaataatgagatgggaaacacaatggaagaattttaagaatgtaggatagaataagaaggtcatacatccaatgggagttccagaaggagataatagaaagaaggtagagagttgatattcaaagacgttaaggctgagaattttccaatgagaatagaaacgaaagacatcaatgatctttgacaggaagcccactgaatttcaagcaaaataaaaagaaatccacgggtagatatactgtgaaactgctaaataacaaagacaaagaaaagatcataaaagctaccagagatacaaggcagattatgtgctaacacacagtggtaattaagactgacagctgacttcgcaacagtaacaatgcaattcacaagtcagtgaaatctgtttgagtgctcagagaaaataactgaaaacttagaattatgtactctatgaacctgtctttcaagagaagaggcaaaataaagacgcttgagaa

SEQ ID NO: 328655 - DNA, 234 bp, Homo sapiens
aatgtgctactgtgttacaaccatgtactacagagatataaatttcaaaaggtcttttaaaaatccagtttctctggactttttagatatacagtttgaattcctaaatcatcacacattcaaatatatgtccacgtgaagatccgttccacttgcatgttttggccacaacaaggtctccaaaagtgattctttggaaaggatgatgtagagattcttatagcactccacagc

SEQ ID NO: 328656 - DNA, 180 bp, Homo sapiens
ctcccaaagtgctgggattacaggtgtgaaccaccacacctggcctaatagcaccatagttctttgaactgttaggaggattaaaagataatatacatatgtgatccacgcagcagagttcctagtacatagaaggctctcagtagatagctgctccattgttaacagccccacctatcc

SEQ ID NO: 328657 - DNA, 1353 bp, Homo sapiens
cagaccccaccttgtcttccctccctggcgtcctcagacttagtcccacggtctcctgcatcagctggtgatgaagaggagcatgctggggtgagactgggattctggcttctctttgaaccacctgcatcccagcccttcaggaagcctgtgaaaaacgtgattcctgggccccaccaagacccaccaaaaccatctctggggcttggtgcaggactctgaatttctaacaatgcccagtgactgtcgcacttgagtttgagggccagtgggcctgatgaacgctcagacccctccagcttagagtctgcatttgggctgtgacgtctcccacctgccccaataagatctgctctgtctgcgacaccaagatccagctggggactcccctgaggcctgcctaagtccaggccttggtcaggtcaggtgcacattgcagggataagcccaggaccggcagagagtggttgcctttccatttgccctccctggccatgccttcttgcctttggaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtggtggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgcatattccatcctatca

SEQ ID NO: 328658 - DNA, 935 bp, Homo sapiens
tggagtgcagtggcgcaatctcggctcactgcaacctctacttccggggctcaagtgattcttccacctcagcctcccaagtagctgggactataggtgtgtgccaccattcccagataatttttgtctttttttggtagagacagggtttcaccatgttggtcagtctggtctcaaactcctgacctcaactgacccacctaccttggcctcccaaagtgctgggaatacaggcatgagccaccacgcctggcctctggtagtatctttacagcagtgtgaaaatggactaatacatctttatagaaaacccaatgaataaataataaagttactataactaataagtttaccaagtttacagatacaaaatcaatatatgaaccatcacatactattttcaaaggttaaataccctttaaagtagcatcaacaatattaacttcttagagataaatctgacaaaacatgtgaaagacctatacaacaaaaaatatgaaattttgctgagagaaattaaagaaggcctaaagagagatcacttctatcatagattgaaagactcaacattgttaagatgtaaattttcccgttaatctacacattcacagcaatcccaaccacaaatccagcaggatttttgggagaaactgacaaactgatgctaaaactcatattgaaataaaaagggcctagaatagccaaaacaactctgaaaataaagttgaaggattaacactacctgatttcaagaattattataaagtttatgtaatcaaaagaggtattggcataaagcagacaaacagatcaatgcaacagaatataaactccagaaaaaaaacccccacatatatggacaactgacttttgacaaagtcccaaaggcactgcagtgtgaagaaagatagccttttcaactactggtgcttgaa

SEQ ID NO: 328659 - DNA, 838 bp, Homo sapiens
catctgtgaaaaacctatagctaatctcatacttactggtgaaagactgaaagcttgccctcttagatcagcaacagaaagggacgtttgctcccaccacctctattcaacattgtaggctgggtgcagtggctcatgtccgtaagcaatcccagcactttgggagtatctttacagcagtgtgaaaatggactaatacatctttatagaaaacccaatgaataaataataaagttactataactaataagtttaccaagtttacagatacaaaatcaatatatgaaccatcacatactattttcaaaggttaaataccctttaaagtagcatcaacaatattaacttcttagagataaatctgacaaaacatgtgaaagacctatacaacaaaaaatatgaaattttgctgagagaaattaaagaaggcctaaagagagatcacttctatcatagattgaaagactcaacattgttaagatgtaaattttcccgttaatctacacattcacagcaatcccaaccacaaatccagcaggatttttgggagaaactgacaaactgatgctaaaactcatattgaaataaaaagggcctagaatagccaaaacaactctgaaaataaagttgaaggattaacactacctgatttcaagaattattataaagtttatgtaatcaaaagaggtattggcataaagcagacaaacagatcaatgcaacagaatataaactccagaaaaaaaacccccacatatatggacaactgacttttgacaaagtcccaaaggcactgcagtgtgaagaaagatagccttttcaactactggtgcttgaa

SEQ ID NO: 328660 - DNA, 1976 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaa

SEQ ID NO: 328661 - DNA, 2031 bp, Homo sapiens
aggaaactgaggcacaaagaaaagactgtaaggcagagccaggatttaagcccaggcctggtcccttagttttgggggggttttgtttgttttacagactataatttgagagaagtagattgaggagatagctcattgaaattgttcattttctgtatagaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacgtagtgttttatgttagttttgggtgatgtagttgagtcccccacttactgagtttacctactgtgtatgactgggctcaatgataaatagaatggttatatcaacactcaaatgagggctgacacacttcacctctccttttacttaagatctctctgcattttttttttttttttgaagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaa

SEQ ID NO: 328662 - DNA, 905 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaacctttagttggccagattggaggccggaaagaccctacaatcaaaaaacgtagcagg

SEQ ID NO: 328663 - DNA, 1198 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgt

SEQ ID NO: 328664 - DNA, 420 bp, Homo sapiens
  misc_feature (8)..(9): n is a, c, g, or t
  misc_feature (12)..(12): n is a, c, g, or t
  misc_feature (15)..(15): n is a, c, g, or t
  misc_feature (28)..(28): n is a, c, g, or t
  misc_feature (30)..(30): n is a, c, g, or t
  misc_feature (33)..(33): n is a, c, g, or t
agcggccnntantantactaaattcgcngncgncgagttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaa

SEQ ID NO: 328665 - DNA, 708 bp, Homo sapiens
aaaatgtatttgttagcatttaatttttttttactattttgtatacttttaattatatacattgaatgtttcattgagacaaaaaatactgtagcattttattttaaaagttttatggtttgcttttaattagaaactttgcctctatgaatagatatttgtcactgctttttctgatatgctttttagcagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagcca

SEQ ID NO: 328666 - DNA, 3534 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataatgattaactggaattattacagtattgaatatgattctaaaataacaatggaaacagtcctttatagatttaggaatattttaaatcattgttgcactaggcacaactaacttttactttggaaatgatagaacttgccagaaaggtacatcttttacacagtagttaaaaattcattgtgtaatatcaaagttgtttcatgattgctcattaagcctcttgggttaactaacttaagaggttatttggtagtgttaagatgaaatttggatcagctaattccaagtttatattttcattattggatggatcagtaattctgctctccctcttgtaaacaagacgcattagggcttaacgtttatgacatgattttaaatcattttaaattgaatgttgatgagcaactaatattaagtgataacctctttggggaagtaggttaggtattttgtggtttgaattctatctac

SEQ ID NO: 328667 - DNA, 3075 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttttttccttcattttgtttttattatagcatgtttgcttaatttacagcaagcagaaaataagctgggtcttgttttgatccaaacattgatgttttaaaggttgtacacaatatttgttaaaaagaacatataaaaatgtcgacgcgg

SEQ ID NO: 328668 - DNA, 4073 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328669 - DNA, 3581 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaagcgttgagctcaaagctttatacttcaagaaaagatccgaagcatgtt

SEQ ID NO: 328670 - DNA, 3691 bp, Homo sapiens
tatatcaaacactgtcttgaatgtgtacttggcctctgttaaaatgatggttttaggaaaggagctaggtttggacagaatagctatataaagccagcagttctcgtagtattattgctgacatgaccagggaggacaagcagcttagcttctcagatcaaaaacaagtaccagtagttcctgcttaaggctggtaaataatatcttgaaattctcaagttggaaaccagtctcaaacccatttctttgcaagaagttgtatatttagggtcatggttagggctttccagtctaggagtccttccagtggtctgtttcttgatagcatgcttttacagtctgcatggatgtaataacgcttttggtatagtgattgtcttgagtactgcttgactctggtcttgatgcccacaaatggctagcgtgcttgtcttcccatgcagtggaaggaagacagttaaatgaaatagtagtattagatatatatgaaaaagaaaacagcaaaataaatttgaagttaatgctttcgtctcttgtaaggtaaggcatatactgcttgcttacacaagaactattggcattttctttttttcgtttgaaacaaatatgaaaaatagtattttggttttaagaaatttttattttagcatacaacatataactgacatttgttttttcttttttgtcttgtaaacttaattcttaaaacttaggaaaatttttggataggacaacttggtgattcagctataacagatcttatttcaataataactttactgcaatatgtattcatacattttcaaatgtgtgccttaggaaatcacaagtgcttttatagtgtgaagtgttaatggctgaatccaactgaatcaccaactagtaagtggggttctggttgatgttctggaataatattgggagattgtgaattgttccagacataccaactgaactttcattcattatcaaagtttgcaaaacttcccaagccccttaacatttagcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328671 - DNA, 3614 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgataggtaaataactttgctttgaaaaagactcatgtattttttaatttcagagtgaacttttgctctaaaaataacaaatttgattactatagaatctaatttttactctaattatatctctcctctgttttgaaagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328672 - DNA, 3061 bp, Homo sapiens
gcggccgcctactactactactactgctcgaattcaagcttctaacgatgtacggggacatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328673 - DNA, 3375 bp, Homo sapiens
cattcccttgtaccatacatatgtctgctgttgtcctgttaatgtaaactgcatttttatcttccaaattcttggatcctagctttccttcatcaaaaagatatattgcctatacatcttaaggacttggacataaaaatttgaggtctttttatgatgttttaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328674 - DNA, 4729 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328675 - DNA, 4019 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaaaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328676 - DNA, 1178 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtgtgaggtgcagacctagaacgtgatttagccttcatttctttcttgggctgggacttggaccgtgatcttgaattggatttagatcttgagtcgacgcggtctcgaattcattagtagcagatcgac

SEQ ID NO: 328677 - DNA, 886 bp, Homo sapiens
  misc_feature (34)..(34): n is a, c, g, or t
tccttgaggtatccccaatcgttcatatagcggngggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328678 - DNA, 1068 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgaagaggatgaggaagatgatgatgatgatgaagatgacacagggatgggagatgagggtgaagatagtaatgaaggaactggcactgcctcaaacaatg

SEQ ID NO: 328679 - DNA, 1611 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatgtatcctacagaataactatttttcttttttttttttttaatgttttgtaagcagttaattttcaaaattattctggtttggtctagtgacaaaacctgtaacttgatttatgtgggcctttgatgttgtgattgtggtcttgtgtaaatgcactctctcttatgaagttaaagtgtaacaggatgtatattcttaagattaaattcagcatattttggttttggaccaggtggtcagatgccacggagtagcaggcagtgctctttggagtagcgtggggttctggggttaagccacagagccctgcttaaaggagagacaggtgcatgcactggggactacttagaaacagctctggtggtcttgtagggtcagaaccactagaaattttgtttatatatagattttaaagtggttgctggggacacatataaacccttaacttctttaacttagcccagtgatcaaggacagttgtgagaattggttgcaaagctccattacagagaaaataatagctatatctggcttagtaaataaaggtagcagtgcgttctggcttacaacatagacctcattttacctagtgttgggtggccgaggaatcaaggtcagtagtagtttgattcaagagtgtgtgatatttgaggcaaaaaaggctagtaattcaaagcaatctaaaggagaatgataattttaaaatacatattcagtaagtctatggttttaaaatagttgaaaagaaataagtaacaggcttatgaatttcatttttgtgcctctgctgctgctgtctcttctgtctgactcc

SEQ ID NO: 328680 - DNA, 429 bp, Homo sapiens
ccttttatgaaaaatgacggctgtagataaaaataagttgtggtcattcccttgtaccatacatatgtctgctgttgtcctgttaatgtaaactgcatttttatcttccaaattcttggatcctagctttccttcatcaaaaagatatattgcctatacatcttaaggacttggacataaaaatttgaggtctttttatgatgttttaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatgtaagtggtaacatctaaaaagtagttctttttgtcctctaataaatgtctgtct

SEQ ID NO: 328681 - DNA, 3058 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328682 - DNA, 965 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgt

SEQ ID NO: 328683 - DNA, 717 bp, Homo sapiens
  misc_feature (8)..(8): n is a, c, g, or t
  misc_feature (66)..(66): n is a, c, g, or t
  misc_feature (78)..(78): n is a, c, g, or t
  misc_feature (96)..(96): n is a, c, g, or t
  misc_feature (101)..(101): n is a, c, g, or t
  misc_feature (110)..(111): n is a, c, g, or t
  misc_feature (174)..(174): n is a, c, g, or t
  misc_feature (178)..(178): n is a, c, g, or t
  misc_feature (193)..(193): n is a, c, g, or t
  misc_feature (195)..(195): n is a, c, g, or t
  misc_feature (197)..(197): n is a, c, g, or t
  misc_feature (227)..(227): n is a, c, g, or t
  misc_feature (279)..(279): n is a, c, g, or t
ctattccngaagcggtacttcgaaggcatttcttgtggctcatagacatgagctgtgagaggggcnggcacaaaagcntgcagtgccgcagcctgnaagancagtgctgnnatgtggtgaccactggatccagaaaaggtgaagaagggcgtcaaagaaatgacgccaccctcngtgngctgtggctacctcncngnctgccgggctcccaatggtttccacaacancgacaccttccacttcctgaaatgctgcaacccaccaaatgcaacgagggcncaatcctggagcttgaaaatctgccgcagcatttcaggaagtggaaggtgtcgtgttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaa

SEQ ID NO: 328684 - DNA, 3787 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaaaacaaaaaaaagaaaaaaaaaaaaaaaaaaaaaaaaaaaaaaacaaaaaaaaagcaagaagaaaaaaaaaagaaacaaaaaaaaacaaaaacgcgcgggggccccccccccccccgacatcgtcccaaccccgcggggggcacccgcgcccacactgatactcagaaaaccaacgacgcaccattatcactgcgagccaaaccatccctggactttgcaaacgaaggcgaggctggggggatccccgacacaaaaaaaaccagcggaggggtcgggacaccgacttgtgtatccaacaccaaatcgacaggagtagtacaacgaccgactcccacggtatacacaaacgcacggaaccgacaggcagaataataataaactccccgccccgtcaggggaacacacaccaaaaaccaacacaacaccgccgcggacccaccccggtgcagagcgcgcaacacagacagggggcgagagaccacatggtacgaagccgaagcggagtggaggacatcccgcggcaggagcaggcggggagacgtagcgccggcggcagcaccgacatcgcacctaggagcacagagagcatacgaggaggagaacgggagaggggctacagcgatagccgagcgaggaggaagcatcgcaaggccagatacaagcagagcagagcgaaaggggaagaacaaagcacataacagacaaagcgctgcgtagtccacgcgcagc

SEQ ID NO: 328685 - DNA, 3004 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328686 - DNA, 3608 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagcca

SEQ ID NO: 328687 - DNA, 3481 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328688 - DNA, 3191 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgataggtaaataactttgctttgaaaaagactcatgtattttttaatttcagagtgaacttttgctctaaaaataacaaatttgattactatagaatctaatttttactctaattatatctctcctctgttttgaaagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328689 - DNA, 4496 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328690 - DNA, 3088 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatccacgaaggcgcgcgctctttgagatccacacacattatacgaagatcgcatcgtcctagaaaactatgcttttctacgcagtagaccgcaactgaagaacacgggtagccgcaagccacttcccgaccatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328691 - DNA, 4306 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328692 - DNA, 2670 bp, Homo sapiens
agaggggatgcagggatttttttccctatttattgagggctttaatactgtttttaatatttttaaatatttctgttctttgtatttcctagcaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaa

SEQ ID NO: 328693 - DNA, 4175 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328694 - DNA, 2729 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaaaaaaaaaaaaaaaaaaaaacaaaaaacaaaaaaaagaaaaaaaaaaaaaaaaaaaaaaaaaaaaaaacaaaaaaaaagcaagaagaaaaaaaaaagaaacaaaaaaaaacaaaaacgcgcgggggccccccccccccccgacatcgtcccaaccccgcggggggcacccgcgcccacactgatactcagaaaaccaacgacgcaccattatcactgcgagccaaaccatccctggactttgcaaacgaaggcgaggctggggggatccccgacacaaaaaaaaccagcggaggggtcgggacaccgacttgtgtatccaacaccaaatcgacaggagtagtacaacgaccgactcccacggtatacacaaacgcacggaaccgacaggcagaataataataaactccccgccccgtcaggggaacacacaccaaaaaccaacacaacaccgccgcggacccaccccggtgcagagcgcgcaacacagacagggggcgagagaccacatggtacgaagccgaagcggagtggaggacatcccgcggcaggagcaggcggggagacgtagcgccggcggcagcaccgacatcgcacctaggagcacagagagcatacgaggaggagaacgggagaggggctacagcgatagccgagcgaggaggaagcatcgcaaggccagatacaagcagagcagagcgaaaggggaagaacaaagcacataacagacaaagcgctgcgtagtccacgcgcagc

SEQ ID NO: 328695 - DNA, 3864 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccagcaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgattttgtcatcttttttgccacatacttaaaactttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 328696 - DNA, 1162 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagcca

SEQ ID NO: 328697 - DNA, 1091 bp, Homo sapiens
acgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaagtaagtgtgctgtgtagcacagtga

SEQ ID NO: 328698 - DNA, 1173 bp, Homo sapiens
  misc_feature (8)..(9): n is a, c, g, or t
  misc_feature (12)..(12): n is a, c, g, or t
  misc_feature (15)..(15): n is a, c, g, or t
  misc_feature (28)..(28): n is a, c, g, or t
  misc_feature (30)..(30): n is a, c, g, or t
  misc_feature (33)..(33): n is a, c, g, or t
agcggccnntantantactaaattcgcngncgncgagttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaaaaaaaaaaaaaaaaaaaaacaaaaaacaaaaaaaagaaaaaaaaaaaaaaaaaaaaaaaaaaaaaaacaaaaaaaaagcaagaagaaaaaaaaaagaaacaaaaaaaaacaaaaacgcgcgggggccccccccccccccgacatcgtcccaaccccgcggggggcacccgcgcccacactgatactcagaaaaccaacgacgcaccattatcactgcgagccaaaccatccctggactttgcaaacgaaggcgaggctggggggatccccgacacaaaaaaaaccagcggaggggtcgggacaccgacttgtgtatccaacaccaaatcgacaggagtagtacaacgaccgactcccacggtatacacaaacgcacggaaccgacaggcagaataataataaactccccgccccgtcaggggaacacacaccaaaaaccaacacaacaccgccgcggacccaccccggtgcagagcgcgcaacacagacagggggcgagagaccacatggtacgaagccgaagcggagtggaggacatcccgcggcaggagcaggcggggagacgtagcgccggcggcagcaccgacatcgcacctaggagcacagagagcatacgaggaggagaacgggagaggggctacagcgatagccgagcgaggaggaagcatcgcaaggccagatacaagcagagcagagcgaaaggggaagaacaaagcacataacagacaaagcgctgcgtagtccacgcgcagc

SEQ ID NO: 328699 - DNA, 205 bp, Homo sapiens
gaggatgggaaggtagacgttgggaagaaaaggaccacaggagggtagaagtggggaaagacaaagatagcaagattgacaggtgatacatatataataaattgttcatttaatcatattaggttattaattacatgtacacaataagtttgggaaatggaattttgcatcaattttggatctgaagtgtctgttactacacatc

SEQ ID NO: 328700 - DNA, 2847 bp, Homo sapiens
cggccgcgttcccacgcctcggctggagccttgcggcgggcattggcgagcgcggccccgccccctggcccagccaatcgcgagccacgccgaccagcgagggggaggtgccgggcggaaggcctgggccggtgcgcgggggcgggtgaggtggccccacccgctcgaggggggggcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 328701 - DNA, 1513 bp, Homo sapiens
cggccgcgttcccacgcctcggctggagccttgcggcgggcattggcgagcgcggccccgccccctggcccagccaatcgcgagccacgccgaccagcgagggggaggtgccgggcggaaggcctgggccggtgcgcgggggcgggtgaggtggccccacccgctcgaggggggggcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacac

SEQ ID NO: 328702 - DNA, 2469 bp, Homo sapiens
gccctcacggaaagttgtgacggtcgagcttgagcctggcgggccgcggagcgttcacctgcggccgggaggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 328703 - DNA, 3734 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328704 - DNA, 719 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaag

SEQ ID NO: 328705 - DNA, 1189 bp, Homo sapiens
  misc_feature (993)..(993): n is a, c, g, or t
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagagggggggtcggctgagaaaaagttttttaaaaacaattgtgtgtgggggggggggccccaggtgttatgggaacaatgggctaaagcggcggaccacaaagaagacgcggggccacgaacaggcgggccgggttcccccccaataaaaaaaagcgcgcggcgccaccgcggggccttggaaaccactcgaacgaggggttcgggggccatcagcggtcccacaccaggggagcccagcggangcgataacaacggccgcgcggcggagtgaaacaagagacgacacgaagacgaggacacaacgaacacctacagaaaagaacaagcacagagacgacgaaaagaacacacgagacagcacaagcaaaacacaaaagcagacgcacatagacacgaccgacagacaccggagcgaacgaagagcacgacgagagaacc

SEQ ID NO: 328706 - DNA, 844 bp, Homo sapiens
taagtcattttaaaacattttaatattagtaagtacatattttataataaagtaatacaactgtatttttttgttttttcaaaattcattaattgagattggctacttccagaaacctttgactgaaaaaatggtgcttgggtgtatttgcaaagaaacccaaggacttattagtgtattttcgttgtttttctttcatctccccattttcttttgactaggaaatgactaatgaagagaagaatattatcaccaacctaagcaaatgtgattttacccagatgagccagtatttcaaagcccagacggaagctcggaaacagatgagcaaggaagagaaactggtactacagaatttattaaacctctggagaattctggaattgtgattggttcatttaactttcttcttggttcttatgacacaacattaacatcagtaatttcacatcattctatgctaaagacttagagttctcaaagtctaaattttcttaaaggttttagttagactgaaaattgtgaacaagtactttgctcagtagctctgtacaggaatcttggtgcttcagtgacctaaaaaccagtcagtaactccagccaataatatagtaattaaggatgggcagacctgtcccacagtggctactggatattaaggatttaagacagatgaaatcatattggccatgtacctccctgctctttgatctattttactctggaatcttgtgatgctcatccatctccatcttccagccttggccatcctcattactgaaggatctttctggtatccagctgggatgtcatttttcttctacaggctgcctgtttttgtaaa

SEQ ID NO: 328707 - DNA, 665 bp, Homo sapiens
tcacccatggtggagtgcagtggcgtgatcttggctcactgcaacctctgcctcctgcgttcaagcaattcttgtgtcttagcctccctattagctagctgggattataggcttgcgccaccttgcctggctatattcaaagtctgtctttactacactgtcccaaagtaatctacatttgggtttgggtctttacagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtaagttaatgtacctgtactgtctgacttgttttccattattcaacaagcatgggttgactgcttttttgtgtgctttgcactttgctgggcaccagcaaaagtgacttgagacaggcacatggcacatgcctgta

SEQ ID NO: 328708 - DNA, 363 bp, Homo sapiens
tcgacccacgcgtccgggcatgttagtttagtgtgggaaatggactctgcacacacatctttcctcaagtatcttctatttttatcatgaattcccttttaatcaactgtaggttatttaaaataaattcctacaacttaaatggaaaaaaaaaaaaaaaaaaaaaaaaaaacaaaaaaaaaaaaaacaaaaacaaaacaacaacaaaaaacacaaaccacacaacaaccacacaaacacaaccacataacaaaacacaaccaacaacaccaccccacccacccacaccacacaaaaaacaaccaccataaccccaccccacccccccccacttcccccacccacccaccaaaccactccccc

SEQ ID NO: 328709 - DNA, 3449 bp, Homo sapiens
agatgaagggattcgattgaatattctcataacacaagatgaccagagtgggagggggcggggaaatgactacaaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328710 - DNA, 3452 bp, Homo sapiens
tcaatgaggcagtggagtagtgaggataggatttacattggtttttaaaagtttagaaacagtaattatttaatacacacactccttaaaaaatttaaaaatccaagcatagcagcagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328711 - DNA, 3764 bp, Homo sapiens
gtctcactctgttgcccaggctggagtgcagtggcacaatcttggctcactgcaacctctgcctcctgggttcaagcaattctcgtgcctcagcctcctgagcagctgggactacaggtgcgcgccaccatgcccagctaatttttgtatttttagtagagacggagtttcaccacattgcccaggctcctgacctggatcacgacctcctgacctcgtgatctgcccgcctcggcctcccaaagtgctgggattacaggcgtatatggtgtttattgtattactcatttttttcttatgttcgaccattttaaaaatacattttcaaaaagttgttcccactgagctttagattcacttatcagtgtttgctagatagttccaggtaatgcgtaagtaccttaaactcaacatgccccagttaagctatcatttcctagtcgtcttcctttatgtcctttctcatagggttgttttctcctctaccttccatctgacgtcaccactctgaggaggccttttccttacaaacaatgtaaacaatccctctgtcatgtatgccattgtggtaaaacaactgtttacattttcaagtccctcacttgttactgagctccttcattgttgatctcttctgtccagtattcttaaactgagctgttgaaatgtattttcctttattcaccacagtatttcatcttacttgtgagcgttggctttttcaaaatgagagacactggttcttttgatccaggccttgaatgtgaggcccagaagtcattccagagcactaatcagttgagcggataattatttggcatttaatcagtgatgatccccatgttagacaaggcgatcactaaatgaggctgtgctttgtcttttaaaggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328712 - DNA, 2379 bp, Homo sapiens
tcacccatggtggagtgcagtggcgtgatcttggctcactgcaacctctgcctcctgcgttcaagcaattcttgtgtcttagcctccctattagctagctgggattataggcttgcgccaccttgcctggctatattcaaagtctgtctttactacactgtcccaaagtaatctacatttgggtttgggtctttacagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328713 - DNA, 3949 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaaaaaaaaaaaaaaaaaaaaaaaaaacaaaaaaaaaaaaaacaaaaacaaaacaacaacaaaaaacacaaaccacacaacaaccacacaaacacaaccacataacaaaacacaaccaacaacaccaccccacccacccacaccacacaaaaaacaaccaccataaccccaccccacccccccccacttcccccacccacccaccaaaccactccccc

SEQ ID NO: 328714 - DNA, 3895 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacatagcattgttagtttagtgtgtgtgcagagtccatttcccacatctttcctcaagtatcttctatttttatcatgaattcccttttaatcaactgtaggttatttaaaataaattcctacaacttaaatggaaaaaaaaaaaaaaaaaaaaaaaaaaacaaaaaaaaaaaaaacaaaaacaaaacaacaacaaaaaacacaaaccacacaacaaccacacaaacacaaccacataacaaaacacaaccaacaacaccaccccacccacccacaccacacaaaaaacaaccaccataaccccaccccacccccccccacttcccccacccacccaccaaaccactccccc

SEQ ID NO: 328715 - DNA, 1645 bp, Homo sapiens
cttctctgcctccctcttcattccaggcaggcagaaggggaaaagtaaaatggcaggcatggctgcagctgcactccccaggtagaagcgtcaggaggccacagctaactgctagggaggctgggaaatgtggcccaacagtgtctgagaggaggaggcaacaaggactcgggcaggcagcatttctgccacacttgtgggtcccactctaaaccctaacagattttctactccaaagattgaaagagtgaagaaatagagtcttgtcacagggatactgaatcttcatctttcccactattgccacttctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328716 - DNA, 3086 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatgagatgtgggaaggggggatctcta

SEQ ID NO: 328717 - DNA, 2901 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagaggaggctcagtttatccatctttcccaaaccacactgttcctcttcacagaactctgcctcttgagactggctaaaacttatagtcttcatcagccat

SEQ ID NO: 328718 - DNA, 1720 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactggtactacagaatttattaaacctctggagaattctggaattgtgattggttcatttaactttcttcttggttcttatgacacaacattaacatcagtaatttcacatcattctatgctaaagacttagagttctcaaagtctaaattttcttaaaggttttagttagactgaaaattgtgaacaagtactttgctcagtagctctgtacaggaatcttggtgcttcagtgacctaaaaaccagtcagtaactccagccaataatatagtaattaaggatgggcagacctgtcccacagtggctactggatattaaggatttaagacagatgaaatcatattggccatgtacctccctgctctttgatctattttactctggaatcttgtgatgctcatccatctccatcttccagccttggccatcctcattactgaaggatctttctggtatccagctgggatgtcatttttcttctacaggctgcctgtttttgtaaa

SEQ ID NO: 328719 - DNA, 1373 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtaacatctcagcactgggttaaaatgccaccttttttattgcatatccttacgaagcaagagtattgagttattaaaattaatatcctgatatttggggggaaatactttaaacaatttctctagagtaactttctgaagtaagttttccaacttctagtgaaatcattaactggttctaaatctattggatctcaaactggtttccaccactgtgaacagaatggactgtagaagcagacctatgtataggtgggaatttagcatacgaagagagtacagatgcatttaaaaccatacggaaaggacagattattatgtaagtcgtgttgggaaaactgcctgttcaacaacagaagaaacctcaacaagaaaacgtgggtgaatatttttataattgtgcagtagtgaagatcctttgaagcaagacataaccagagccataaggaaaggtgttttacatttgatacatcaaagttcaatttatggcaggtggacaccttcatgccattta

SEQ ID NO: 328720 - DNA, 3084 bp, Homo sapiens
ctctagtcagaagagatatgaggaaatcgttacggaagtagcactacattaagaaaatggctaaacccgacacagtagcattgtgccaatttctggttggaatggtgacaacatgctggagccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328721 - DNA, 2858 bp, Homo sapiens
taagtcattttaaaacattttaatattagtaagtacatattttataataaagtaatacaactgtatttttttgttttttcaaaattcattaattgagattggctacttccagaaacctttgactgaaaaaatggtgcttgggtgtatttgcaaagaaacccaaggacttattagtgtattttcgttgtttttctttcatctccccattttcttttgactaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328722 - DNA, 1728 bp, Homo sapiens
aagagtggtatcaacgcagagtcgccattacggccggggcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328723 - DNA, 3576 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaaatggaaa

SEQ ID NO: 328724 - DNA, 3151 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagaggggacttaaaacaacacaattttattccctttagagtttctaaaattcagcccagaatttataaaatttagccctcacgtgagcccagttccaggttgggaagcagggcctggcggcccttccagggacctctgatgggagcgatgcatttcccgtggctctgagagtggccgtggactcgtgtggctttgacgttgcccttccttcaacttccagttttccgtgctccattcgcttacaccttccaaccctccttctcccgttcaccggccctcttcgtgttttacagaccccgggttgaggacattcaagcccttcctgaaccaagctgggattaattcttccgt

SEQ ID NO: 328725 - DNA, 2020 bp, Homo sapiens
aaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtaagttaatgtacctgtactgtctgacttgttttccattattcaacaagcatgggttgactgcttttttgtgtgctttgcactttgctgggcaccagcaaaagtgacttgagacaggcacatggcacatgcctgta

SEQ ID NO: 328726 - DNA, 2838 bp, Homo sapiens
acttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaaggaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaaccaaaaaaaaaaaaaaaaaaaactccagggggggccctggaccccaaatcccccttttagtgaggtcgttttaaaattacttggccgcccgtttaacaccttcttgacttgggaaaacccctggtgtttcccca

SEQ ID NO: 328727 - DNA, 2784 bp, Homo sapiens
acttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaaggaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaaccaaaaaaaaaaaaaaaaaaaactccagggggggccctggaccccaaatcccccttttagtgaggtcgttttaaaattacttggccgcccgtttaacaccttcttgacttgggaaaacccctggtgtttcccca

SEQ ID NO: 328728 - DNA, 721 bp, Homo sapiens
aggacaataaaacttgagccttgactttaggaagattataaactggttacagagataaagacaaacctgaaagactagtaatataaaacacttaagagtataagcacccaacaaaagacataaacagccaatagtatttggtaactcaggagaaaggaaaaaatcacagactcagtttagacagaaatctgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaaccaaaaaaaaaaaaaaaaaaaactccagggggggccctggaccccaaatcccccttttagtgaggtcgttttaaaattacttggccgcccgtttaacaccttcttgacttgggaaaacccctggtgtttcccca

SEQ ID NO: 328729 - DNA, 956 bp, Homo sapiens
tgcactccagcctgggtgacagggtgagattcgccctcaaaataaataaataaatacataaaaagctagaataaggatcaccctgtaactataaagatgaatgcaggcaccaagaactactgcagaggagccttattttgaagaaccgtgctgcagttcaaagccgccgctgaacagacggcagagaaggggcttgcacgtggccacagatctaacatgacagacaatgggtgtctagtactaacacagctgggtgttttcccagcatgatttggtggctaaattaattttatcatctttccttctaacttattatcattctgatattaataccatggctaacaaccaatctcactatatgatgagaccactattctgaaatgtaatgtctgccacttacagcttttaatctagtaaagtgctccctaaacctaaaataattgctgtatattgttccctcattgttaatatactacagaaataacaccaataaaatgtcttaagtgcattaattggcaccaaaatgaatataatattttaaacctatttactggcatagctgagattattaaaggtgcaagccctcagtgcagatgggtaatgaaaacaaccgaagacaatctcttggcaaaggaaaggtcagactgatttcatttccttaaacttatgacccgatcatggggacaacgtgaccttaggcattatttgcttttacataaagattagacttcagatgtaggacaatgcaaactacagataagagatacatacgcatggatacacacaggttatatgtaaaaatgattttttgtaagtttagagttttgcaaccatcagcacaatccagttttagaacatttccatttcctcaaaaagctctcacttgcaccagtagacagctagtgggtatgtggggttatctcatttggatgtaagtggcatttttctataatgac

SEQ ID NO: 328730 - DNA, 719 bp, Homo sapiens
acccaacatagtgctcatatatgtcatcaaatttggtattaaaacatgcattattagtaatatacattgttatgaataaagcagaaatatgggccgggtgcagtggctcatgcctgcaatcctagcactttgggaggccaaggcaggcggatcacgaggtcaagagatcgagatcatcctggccaacatggtgatacgccatctctactaaaaatacaaaaattagctgggcatggtggcgcacgcctgtagtcccagctactcaggaggctgaggcaggagaatcacttgaacctgggaggcagaggctgcagtgagctgagatcgcaccgctgccctccagcctggtgacagagcgagactccgtctcaaaaaaaaaaaaaaaaggaagaagaagaaatatgcagctataacacttcgctaatagacgtgaaagattcctgaataggctggacactgtggctcatgcctgtaatcccagcactttagggtgctgaggtgggcagatcacttgaagccaggagtttgagaccagcctggccaatgcggtgaaaccccatcactgctaaaaatacaaaaatcagtaggggtagtggcacgcatctgtggtctcagctactcggaaggttgaagcatgagaattgcttgaacgtgggaggcagaggttgcagtgggccgagatggtgccactgcactccagcctgggtaatagagtgaga

SEQ ID NO: 328731 - DNA, 92 bp, Homo sapiens
cctgcttctgaaccatcgtgttcaactgtgaaactcacactttggtgaccacgactccaaaactcacttaatacacccaaggtcagccccag

SEQ ID NO: 328732 - DNA, 919 bp, Homo sapiens
aaactaagttccagtacttggatgccaacttgctgacgacaaggcacttccttacaatgagcctggaattctaagcagcagtttcacaatctgtaattgcacgtttctgccctttacaataaagaaatacacaatttcctttcaccacccacacccaccaaaaataccaccacactccaacacaccccacgaagaaagcgagaaagcccaaaactgggccccccaccacaaccgcacccccacgaatctgtcatacatccacaagacacccgggccctctgagcacccacggcgaacggccgccaagccgccacccccctcccaggcggcagcccccacatgcgccacgtcgtacatcacgtcacccaacgccaccgacctatgcgcaatcgcgcgcatagccccgtactcgggccagcagccccaccccagccagccacactgctccccctcgcacaccacaccaagatcgcgcgacccaacgcacccactccgcaccacaccccacaccacccccaccccgctcgaccagcatgtgtcacaaccccgtacccgcaccctgagtaccacgaaacggacaggctaacgacgcgaagtacctcacccacccgaccgaacgcgatccacggtcccgtaagcgctaattccagactacacccccatagctcgccgcaatggtctgcacgtccaccccacaccaacagagatcactacagaaatatgcctccaaccccgcccacgttaaactccccactccacacgcagcaatgtcactcggcaccgcgcctttcacggtgtgacaggtcttctccatagatgtcggatcggcctccttactacctccccccttacgaaagagtacacactccacaaccacagacctccgcccaaggcgccgcccgcgcgccccgcgcacgtg

SEQ ID NO: 328733 - DNA, 179 bp, Homo sapiens
gtggggtagaagtagagaaaaggcacttaagtaaaaatactacatttcacaaaattctatgtcctttgaattcttatgaaacatttttaatgaatcaattttatatttaccctgtgattagtgaaaattataaatatatgcacttcatacttatgaaagcactgagatgaagcccttta

SEQ ID NO: 328734 - DNA, 839 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328735 - DNA, 654 bp, Homo sapiens
tctagagtatcccacagcacagaggaggcagcacagaggagggtgttgaactcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328736 - DNA, 592 bp, Homo sapiens
  misc_feature (19)..(19): n is a, c, g, or t
  misc_feature (36)..(36): n is a, c, g, or t
aaggggcatgagattaccncgccccctcccgggtancgggatacactgtccaaacctttcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328737 - DNA, 624 bp, Homo sapiens
tcagctcggacacaagcggctcgtcagcagaaaaccacacttctcaaaccttcactcaacacttccttccccaaagccagaagaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccatggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaaaaaaa

SEQ ID NO: 328738 - DNA, 1100 bp, Homo sapiens
  misc_feature (947)..(947): n is a, c, g, or t
  misc_feature (957)..(957): n is a, c, g, or t
  misc_feature (970)..(970): n is a, c, g, or t
  misc_feature (973)..(973): n is a, c, g, or t
  misc_feature (977)..(977): n is a, c, g, or t
  misc_feature (984)..(984): n is a, c, g, or t
  misc_feature (986)..(986): n is a, c, g, or t
  misc_feature (995)..(996): n is a, c, g, or t
  misc_feature (1012)..(1012): n is a, c, g, or t
  misc_feature (1025)..(1025): n is a, c, g, or t
  misc_feature (1028)..(1028): n is a, c, g, or t
  misc_feature (1031)..(1031): n is a, c, g, or t
  misc_feature (1034)..(1034): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaacaaaaaaaaatgtggggggcgcccgaaagntttaaacagnggggcgggccagngangaanggcaggncngaaccgggnnagggggttcccaaaangcggggcggggtnaancanggngggctgctcaccgcaccccccccgccgcgggcaaggaagaaacgcgaggacacgagccaatagacg

SEQ ID NO: 328739 - DNA, 670 bp, Homo sapiens
gcggccgcctactactactaaattcgcggccgcgtgtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328740 - DNA, 1059 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaaccccaaacacaacaccacaaaagcgagcaagagcacacgggcccgcccacaccaccgcagaacaacagggcacaaagacagcaggcggcaaccctagaacgaccgggaacagcccccccagccgcccgggcccccttcggcc

SEQ ID NO: 328741 - DNA, 1209 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaaaaaaaaaaaaaaaaaaaaaatttttgggccgcttgggccctgaaaaggtttttaaaccctttgtttgggcggggggccccagttgtgcttatgtctaaccctggttgctctcaggctgtttccccaagggagaccctggcgccattcgcattgcgctgctgtgtggttctctcccccattataaaaagcgcccgggagggacccgggcgggttctgtaacacattcccgtgggcgttcggagccactacgggtcctttcaccaggggtccaagggagtcgcattaatctggc

SEQ ID NO: 328742 - DNA, 1554 bp, Homo sapiens
  misc_feature (924)..(924): n is a, c, g, or t
  misc_feature (940)..(940): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaaaaaaaanaaaaaaaaacaacacnaaaacaaacaaaacaaaaacaaaaagacgacacaaaaaaaaaaaaaagaaacaagaaaacacaaaactgggggggcggagcggccccccacgacaaggaccatgagaaccacgtggggggggcgcggaccaacaaaggaagaaaacacgaagcagcaagaaaaaagagatcacacacaaaagaagcagggagaagaaacacaaagtggagagaaacacacacaaaacaagagaacacgcgcggggaagaacgaggtgagtaaacaaacccataggacaggaaaggagagagaaaaaaaaggagaataaacacacagaagagtacacgcgagacagagtcgaaatgaaaaaaaagacgcgcaagcgagggtgtgaaaaaaaaacaaccaaaacaaacaagaaaaaaagacgagacaagaagaaagagagacggacgagaggaagagaaagaagagaggagaaagagagggcgaaaaaatagtaaagaaagacaaaagaggagagagaagggaaggggcaaagaagagagaggcgcagaccgagacacagacaagaaaataagaaaaagaaggagaggaaggcggagaagagcaagaaggaaaaaagtcaaaagag

SEQ ID NO: 328743 - DNA, 896 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaaaaacacacacacaaacaacacaaaacactttcagacaaacacaagaccccaca

SEQ ID NO: 328744 - DNA, 1287 bp, Homo sapiens
  misc_feature (853)..(853): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaaaaaaaaaaanaaaaacattttaaaaaaaaaaaaaaaaaaaaagggggggggggcccaaaaattcccccggaggggcgcccaagctaccggctgaccccggtttcctgggcacactgtggcgccccaaagagggaggcgagataaaaagccaacagacttgggcgggcgtttaacacacgtgccgagactgccggaacatctgcggacctcgcgacccctggggacgagcacccctaactctccgggggggcggggggaccccattgttgcgggccacaatattcccttcgaagagactttaacgccgccctgggggcaacactctacacatctttccccacgtgcatcttcccgtgcttaacacccagccgcgcatatctctcccgcgtctgaaaaaatttgccgcatcaccgggtatgtgcttatgacacatttttttacggc

SEQ ID NO: 328745 - DNA, 846 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccacctagacgtcgctttccacctagacgtcgctttccacctag

SEQ ID NO: 328746 - DNA, 869 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaacagaaaaacaaagaacaacaaaaggg

SEQ ID NO: 328747 - DNA, 1048 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaaaaaaaaaaaaaaaaaaaaaaaaaaaaaaaaaacctcgggggctttttttggggggggggaaaaagggttttaaaagggcctgggccatgtttttcccggcccccttttttttaacagggggaaaactgggcggccccctaagggggggcgaaaaatcagaaacccggtaacctaatttttaggaaaaacggaacacgcaaacaag

SEQ ID NO: 328748 - DNA, 1506 bp, Homo sapiens
  misc_feature (876)..(876): n is a, c, g, or t
  misc_feature (892)..(892): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaaaaaaaaaaaaaaaaaaaaaaaaaaaaaaaaaanaaaaaaaaacaacacnaaaacaaacaaaacaaaaacaaaaagacgacacaaaaaaaaaaaaaagaaacaagaaaacacaaaactgggggggcggagcggccccccacgacaaggaccatgagaaccacgtggggggggcgcggaccaacaaaggaagaaaacacgaagcagcaagaaaaaagagatcacacacaaaagaagcagggagaagaaacacaaagtggagagaaacacacacaaaacaagagaacacgcgcggggaagaacgaggtgagtaaacaaacccataggacaggaaaggagagagaaaaaaaaggagaataaacacacagaagagtacacgcgagacagagtcgaaatgaaaaaaaagacgcgcaagcgagggtgtgaaaaaaaaacaaccaaaacaaacaagaaaaaaagacgagacaagaagaaagagagacggacgagaggaagagaaagaagagaggagaaagagagggcgaaaaaatagtaaagaaagacaaaagaggagagagaagggaaggggcaaagaagagagaggcgcagaccgagacacagacaagaaaataagaaaaagaaggagaggaaggcggagaagagcaagaaggaaaaaagtcaaaagag

SEQ ID NO: 328749 - DNA, 876 bp, Homo sapiens
  misc_feature (859)..(859): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtctatagtgagtcgtattacntcctggcccgcgctttc

SEQ ID NO: 328750 - DNA, 805 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggtcgacgcggccgcgaatttagtagtagtagtaggcggccgc

SEQ ID NO: 328751 - DNA, 596 bp, Homo sapiens
atgaggcactctagaggctcccccagcacagagaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328752 - DNA, 886 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccatggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaaaaaaa

SEQ ID NO: 328753 - DNA, 642 bp, Homo sapiens
  misc_feature (62)..(62): n is a, c, g, or t
  misc_feature (64)..(64): n is a, c, g, or t
cttagatgtgaggtctcgctgcggatgtggatcacggtggacgtcgggggagcagcgtatgngnggcgcccccagcatagccacttcctgctcctccttgagcatctcgtagttgggaggctggccgctgttgacaggagagaaggtttgcacccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328754 - DNA, 708 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccatgccgagtcctgcatcagccctttatcctcacacgcttttctacaatggcattcaataaagtgtatatgtttctggt

SEQ ID NO: 328755 - DNA, 1482 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaaggtgcgtatggccctggcggaaatccagggggtgccggtgagcctggggctccacctgcccacatgctgcctggggtggggacttgtgtgtccctgtgactgtgagtttgtgtgcacgtctgtcctgtgtgtgcccacgtcagtggctttgtctgtgtgatctgtgtgtgtgtgtggcttggggaatctgcccagtgcaggtctaggaggaggctccaggaggctggctggctggctcagagtctgtccccggctatccactagcccagagcagttctccctatagcccagtaagaaattacaccttcaccttccagactggcacccaggctctcccagaaagtgagaagggaactcacaggtgacttcaccccatggtggggagaacagcctgtgctggggccaaggcagaaggaggatgagccccgaggctcctggagagtctgagccgggtgaggaaggggaggaggtggtccctgatctcagggcagggaggagccaatgaggagacggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328756 - DNA, 1043 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagactggcacccaggctctcccagaaagtgagaagggaactcacaggtgacttcaccccatggtggggagaacagcctgtgctggggccaaggcagaaggaggatgagccccgaggctcctggagagtctgagccggtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328757 - DNA, 541 bp, Homo sapiens
  misc_feature (5)..(5): n is a, c, g, or t
  misc_feature (7)..(7): n is a, c, g, or t
  misc_feature (42)..(42): n is a, c, g, or t
  misc_feature (47)..(47): n is a, c, g, or t
  misc_feature (54)..(56): n is a, c, g, or t
  misc_feature (63)..(63): n is a, c, g, or t
  misc_feature (68)..(68): n is a, c, g, or t
  misc_feature (70)..(72): n is a, c, g, or t
  misc_feature (83)..(83): n is a, c, g, or t
  misc_feature (118)..(118): n is a, c, g, or t
tgacntngggggggacagggttgtggggcccccccagcacanccacntcgtgcnnntccgacntctcntnnntggggggctgnccactgttgacaggagagaagaggtttggacagtntgaccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328758 - DNA, 1413 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaaggtgcgtatggccctggcggaaatccagggggtgccggtgagcctggggctccacctgcccacatgctgcctggggtggggacttgtgtgtccctgtgactgtgagtttgtgtgcacgtctgtcctgtgtgtgcccacgtcagtggctttgtctgtgtgatctgtgtgtgtgtgtggcttggggaatctgcccagtgcaggtctaggaggaggctccaggaggctggctggctggctcagagtctgtccccggctatccactagcccagagcagttctccctatagcccagtaagaaattacaccttcaccttccagactggcacccaggctctcccagaaagtgagaagggaactcacaggtgacttcaccccatggtggggagaacagcctgtgctggggccaaggcagaaggaggatgagccccgaggctcctggagagtctgagccgggtgaggaaggggaggaggtggtccctgatctcagggcagggaggagccaatgaggagacggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328759 - DNA, 401 bp, Homo sapiens
  misc_feature (382)..(382): n is a, c, g, or t
gtgaactagaggatccccccaccttatgcgtgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagcataaggttggnggatcctctagagtcacca

SEQ ID NO: 328760 - DNA, 594 bp, Homo sapiens
  misc_feature (441)..(441): n is a, c, g, or t
  misc_feature (451)..(451): n is a, c, g, or t
  misc_feature (464)..(464): n is a, c, g, or t
  misc_feature (467)..(467): n is a, c, g, or t
  misc_feature (471)..(471): n is a, c, g, or t
  misc_feature (478)..(478): n is a, c, g, or t
  misc_feature (480)..(480): n is a, c, g, or t
  misc_feature (489)..(490): n is a, c, g, or t
  misc_feature (506)..(506): n is a, c, g, or t
  misc_feature (519)..(519): n is a, c, g, or t
  misc_feature (522)..(522): n is a, c, g, or t
  misc_feature (525)..(525): n is a, c, g, or t
  misc_feature (528)..(528): n is a, c, g, or t
gcggccgctccaacatcagaatggtcatgaagatgcccaaaatcagggcccagatgttcaggcacttggcggtggaggcatatgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaacaaaaaaaaatgtggggggcgcccgaaagntttaaacagnggggcgggccagngangaanggcaggncngaaccgggnnagggggttcccaaaangcggggcggggtnaancanggngggctgctcaccgcaccccccccgccgcgggcaaggaagaaacgcgaggacacgagccaatagacg

SEQ ID NO: 328761 - DNA, 452 bp, Homo sapiens
gcggccgcctactactactaaattcgcggccgcgtcgaccttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccatggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaaaaaaa

SEQ ID NO: 328762 - DNA, 461 bp, Homo sapiens
  misc_feature (57)..(57): n is a, c, g, or t
ctaggtggacatccggctggggtggtctccccacctcctcacattatgcctacacgnacacagacacatgcaggtgcctttgcggaaaccaagtcagggttcttcaagtcaccaagggaagggcaggaaccactcttgcctctcagtcccacaccaggcagctgtctcacactttaccagctgtgagagacacatcagagccctgggcactgtcactgcttgcagccttgagtgtaactccctccttttctatctgagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328763 - DNA, 420 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcggcaaaggtgtctggggtacacctggacaggtgtatgatgtggaggagtgattgtgaaagatctccaactatgat

SEQ ID NO: 328764 - DNA, 908 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328765 - DNA, 629 bp, Homo sapiens
  misc_feature (16)..(16): n is a, c, g, or t
  misc_feature (31)..(32): n is a, c, g, or t
ccggcccaagtttaancccctcgaggattannggtagcgaggcctgggtgccgcgctggtcttgtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328766 - DNA, 655 bp, Homo sapiens
tctactgtgttcaatctctattgtttcaccctatgcaatcctgaccataaccctgaatgggcattaccagccttttctccggagaggaaacaggagctcagaggagttcaaagacatgctcagggtcacatagttcagcgtctggtcagacgctgaactataaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328767 - DNA, 490 bp, Homo sapiens
  misc_feature (62)..(62): n is a, c, g, or t
  misc_feature (64)..(64): n is a, c, g, or t
cttagatgtgaggtctcgctgcggatgtggatcacggtggacgtcgggggagcagcgtatgngnggcgcccccagcatagccacttcctgctcctccttgagcatctcgtagttgggaggctggccgctgttgacaggagagaaggtttgcacccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacatagttcagcgtctgacgggtaggaga

SEQ ID NO: 328768 - DNA, 1573 bp, Homo sapiens
  misc_feature (943)..(943): n is a, c, g, or t
  misc_feature (959)..(959): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaacaaaaaaaaaaaaaaaaaaaaaaaanaaaaaaaaacaacacnaaaacaaacaaaacaaaaacaaaaagacgacacaaaaaaaaaaaaaagaaacaagaaaacacaaaactgggggggcggagcggccccccacgacaaggaccatgagaaccacgtggggggggcgcggaccaacaaaggaagaaaacacgaagcagcaagaaaaaagagatcacacacaaaagaagcagggagaagaaacacaaagtggagagaaacacacacaaaacaagagaacacgcgcggggaagaacgaggtgagtaaacaaacccataggacaggaaaggagagagaaaaaaaaggagaataaacacacagaagagtacacgcgagacagagtcgaaatgaaaaaaaagacgcgcaagcgagggtgtgaaaaaaaaacaaccaaaacaaacaagaaaaaaagacgagacaagaagaaagagagacggacgagaggaagagaaagaagagaggagaaagagagggcgaaaaaatagtaaagaaagacaaaagaggagagagaagggaaggggcaaagaagagagaggcgcagaccgagacacagacaagaaaataagaaaaagaaggagaggaaggcggagaagagcaagaaggaaaaaagtcaaaagag

SEQ ID NO: 328769 - DNA, 969 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtctgctcaaaaaacactctcttaactcatgtcggccgccttgcccagtcgatttagcttgcg

SEQ ID NO: 328770 - DNA, 1115 bp, Homo sapiens
  misc_feature (992)..(992): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtaaaaaaaaaaaaaaaaaaaaataaataacttattattaataattaaaaatatataattttttaataaaataaatattttttttntattcttattttaaaattaaaaaaaaaaaccttccaggggggccccggaccccaatatttcccctttaggggaggctatttaaaaataacttggcccgttttttagaatataacccccttttg

SEQ ID NO: 328771 - DNA, 1185 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtgctcgaagaatcgcgtcattcaaacggctagtaaaccgctttgtggttaggactgcggccgaggaaaagggtttgattaaccccgttccgtgtggggcacgggccccttggggcaggtacaacttggcaatgggggcctcgaggaaacccgtccggagactggggctgggttctccccatataaagaacgccggcgacacccggcttttgaaccaaccacattgggtttctgaggcaacacggactacacagggcagggaccgttaaccggcggggg

SEQ ID NO: 328772 - DNA, 871 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacaggcataaggtgggggtacaagctcgaggttcgatgatga

SEQ ID NO: 328773 - DNA, 816 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagccgagtcctgtatcagccctttatcctcacagtctggggatcctcatagagca

SEQ ID NO: 328774 - DNA, 870 bp, Homo sapiens
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtacctatatcttccttcttcccgtccctccct

SEQ ID NO: 328775 - DNA, 1082 bp, Homo sapiens
  misc_feature (1082)..(1082): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaaaaaaaaaaaaacaaaaaacaaaacaaaacacaaccaccgcggagcgccccatatacggcggggggcgaggaaaaacgcgggtcactagaacgggcgccacgcgcgccgaacgcgtgttcctccagcaccccagcttctctgggccacccaggcgggacaacaggccggagtctcccaatagaggggagccgataaaactcagaaaacaccggtaccctcgttagccgaccacacaccgn

SEQ ID NO: 328776 - DNA, 837 bp, Homo sapiens
  misc_feature (765)..(765): n is a, c, g, or t
caacacaggggcagtctccaggacctccacaccattaacaagatgagccttgtgctcccttgggctctagagaggaagcccctctgagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggnagccgagtcctgtatcagccctttatcctaccacgctgttccacaatgcacgtgataagatcctgagagtag

SEQ ID NO: 328777 - DNA, 724 bp, Homo sapiens
tctactgtgttcaatctctattgtttcaccctatgcaatcctgaccataaccctgaatgggcattaccagccttttctccggagaggaaacaggagctcagaggagttcaaagacatgctcagggtcacatagttcagcgtctggtcagacgctgaactataaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328778 - DNA, 1103 bp, Homo sapiens
  misc_feature (669)..(669): n is a, c, g, or t
tctactgtgttcaatctctattgtttcaccctatgcaatcctgaccataaccctgaatgggcattaccagccttttctccggagaggaaacaggagctcagaggagttcaaagacatgctcagggtcacatagttcagcgtctggtcagacgctgaactataaggaggagcaggaagtggctatgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggtaaaaaaaaaaaaanaaaaacattttaaaaaaaaaaaaaaaaaaaaagggggggggggcccaaaaattcccccggaggggcgcccaagctaccggctgaccccggtttcctgggcacactgtggcgccccaaagagggaggcgagataaaaagccaacagacttgggcgggcgtttaacacacgtgccgagactgccggaacatctgcggacctcgcgacccctggggacgagcacccctaactctccgggggggcggggggaccccattgttgcgggccacaatattcccttcgaagagactttaacgccgccctgggggcaacactctacacatctttccccacgtgcatcttcccgtgcttaacacccagccgcgcatatctctcccgcgtctgaaaaaatttgccgcatcaccgggtatgtgcttatgacacatttttttacggc

SEQ ID NO: 328779 - DNA, 445 bp, Homo sapiens
gtgaactagaggatccccccaccttatgcgtgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328780 - DNA, 571 bp, Homo sapiens
  misc_feature (28)..(28): n is a, c, g, or t
agtattcggtcgagcgctagataaaaanacgcctgggtcggccacgacgatgacgtcgtgaatcacactccacgatggagtactgtacggtcacttactggttctatctgcatggagtccaagcgagctcgtattatcaaacttacctgcctccgctgcgattcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 328781 - DNA, 486 bp, Homo sapiens
  misc_feature (5)..(5): n is a, c, g, or t
  misc_feature (7)..(7): n is a, c, g, or t
  misc_feature (42)..(42): n is a, c, g, or t
  misc_feature (47)..(47): n is a, c, g, or t
  misc_feature (54)..(56): n is a, c, g, or t
  misc_feature (63)..(63): n is a, c, g, or t
  misc_feature (68)..(68): n is a, c, g, or t
  misc_feature (70)..(72): n is a, c, g, or t
  misc_feature (83)..(83): n is a, c, g, or t
  misc_feature (118)..(118): n is a, c, g, or t
tgacntngggggggacagggttgtggggcccccccagcacanccacntcgtgcnnntccgacntctcntnnntggggggctgnccactgttgacaggagagaagaggtttggacagtntgattcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcatcatcccagtgttggtcgtccaggcccagcgatagatcaggaggcatcattgaggccaggagctctgcccgtgacctgtatcccacgtactctatcttccattcctcgccctgcccccaggccgagtcctgcatcagccctttatcctcacacgcttttctacaatggcattcaataaagtgtatatgtttctggt

SEQ ID NO: 328782 - DNA, 193 bp, Homo sapiens
gcagagagcactaatcttgggacacttaactcttaagttggatctaccaatgcctgacaggctctggcgacccctggcaccctcactatctgactttcaacagttttgcactgatctcacttagaactcaaatttgcctaggtcaggacaaggactctgaacccatagatgtcctatgctctagttttctccc

SEQ ID NO: 328783 - DNA, 404 bp, Homo sapiens
agaggttgggagcacctgggtggtgaagggagtatgtggaggaagggcctggaggtatttaccccccgccagataaacacctgttggcagaattagccttgatctgacagccccaggaagcttagaaatctgaagatcctgaccatgaaagccatccaaagatggcaaggaccgcctgagaagtagtgagctccctgtcactggggggtatgtaaggacatggttagtgactgcttggcggagatgctggagagaggattcaagccaggaaagaaggtggggtcctgagattctgtgactgggtagagggaagatgcggccagtggggattcattagttcctcctctgagatttctggactcctccttccctggctctctccctgctctacatacggaatttgc

SEQ ID NO: 328784 - DNA, 197 bp, Homo sapiens
ggtcaggcactgaatgcctggtcaggcactgaagcctggtcaggcactgaagcctggtcaggcactgaagcctggtcaggcactaagcctgggcaacatgatgaaactgtgtctccacaaacacttaaaaaaaaataaataaggcagtcatggtgacacatgcatattgtcccagctacttgctggctgaggtggga

SEQ ID NO: 328785 - DNA, 871 bp, Homo sapiens
gatgattcccatggacttctacggatatattaatgctgttttggaggaccctctgtgtgccgcaggctccatgacacctaatgttggtggatgcgttctggtgtgtatgtgtttccatgaaatttacaaactaacacacagcattctaacatgttcacttaggaactttcaaaactttgccctacaagacaacattctcaatagagaaaatttagaaaaatagcagcacaaaagaggaggcaaaagtcacttatattattaatataatactactctagagctaaccacaattgaattttattttgcctcagtatttttttcccatgcacattcctaggcatgctatcttaaagcaacagtttgtgtagttaatctgttgctctccccacagttatattttaactagggtactgaatacagaacgttttgcacatgcatttttgctggagaaaccacagatatgtagccatttatagtgtttcttagctatcgcatgcatcatttcctctcctacttcctcctgtcactggcagtcctgcagctggcctgccttgccactcctgacatctgagtcatcactgacatctctctccccaggcctgctcaaggagctcttactaagctttgttatttttttctctccaagatttttcagatctgtactttatttttcaacgccccaactcaatcctaatctgcacttcaatcatctcgcgctgtcagtgtcagtttcttggctttgagctccttctcttttcaattcacattttcaaaagccattttctcccaagtgttttctcacctttcctttcttagcagaactcccccccgccgtggttacacctccacgttactttccaggtatgcccac

SEQ ID NO: 328786 - DNA, 583 bp, Homo sapiens
ctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctc

SEQ ID NO: 328787 - DNA, 2157 bp, Homo sapiens
ctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtggggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaacagtttgctgactcctttgtcactggtgaatggt

SEQ ID NO: 328788 - DNA, 4165 bp, Homo sapiens
cgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328789 - DNA, 649 bp, Homo sapiens
gcatggggctgagggtggcgctttctacctattaaaatgagtcacactcaagagaaagaaagctgagacctgctgtataattagagagttcattcagtgctttcagaattctttcatatctcattttaatccacagaagattggaaattttgttcttatttaatagatacgtagctgagggaagtaacaacgtgttcacagtcaccccacaaattaaagagcaagtcagagaatgacatagactcgttgtttggtctgatggtggttccgtctcaaaatcggctggacaagcacagtgttccatggctccatggctggctgttctgtgaccgtaggcagattccttaaccacccaatgcctccattttttcctctgttacatccaagcctttccttttgccaccttctctttctgctgtaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtaagggggacatacctgcccacattgcacctaaggcctgcagccaggccttttgggcttgtcagtcaccctaaaaaaggcactggt

SEQ ID NO: 328790 - DNA, 4111 bp, Homo sapiens
cgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacaccattccttccaggagcagtaggtgggaggtttgacccagagaagccaatccttgcattccaggagtggcctgtgcctcccacctcttccttcccactgccaaaggcctgtgttgagaaagatgtcatgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328791 - DNA, 1800 bp, Homo sapiens
  misc_feature (24)..(24): n is a, c, g, or t
aaataagaaacagaggccaggtgnctacgtctggacagcatccatccactccggcctgctcagcctccaggtccttcctcatgctcagtcccagaagcccaaggctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328792 - DNA, 3635 bp, Homo sapiens
agaaccaagttgacctagaaaacgctaaaactttaaggattatctaacccccagtagcaccgagacactgtggttcaattctcataaagttcaaataacagaacagccgtgccgggctatcactgaaatggtcaaacctcctgtcttgtgacctttccttctcttcagggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328793 - DNA, 4083 bp, Homo sapiens
cgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328794 - DNA, 3311 bp, Homo sapiens
cgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgccagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328795 - DNA, 3512 bp, Homo sapiens
cgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagcacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 328796 - DNA, 1827 bp, Homo sapiens
cgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcagctctggggttggcaactctgccacccgggcccgtttgctgagttcttcaccagg

SEQ ID NO: 328797 - DNA, 5415 bp, Homo sapiens
ttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacgtttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttaataacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttgtaatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatca

SEQ ID NO: 328798 - DNA, 3337 bp, Homo sapiens
ggacctacttttcacaggactgaaagcaaaatcattacacttagggtatagcataatagctcttaattgtgtactaagaatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatca

SEQ ID NO: 328799 - DNA, 5897 bp, Homo sapiens
  misc_feature (5745)..(5745): n is a, c, g, or t
ttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacgtttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttaataacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttgtaatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcaaaaaaaaaaaaaaaaaaaaaaaaaaaaaaaaaaaaaaaaaaaaaaaaacagaagaagaaaaaagaaaaaaaagaagaagcaaaaaagaagagaaaaaaacaaaaaaaagaagagggggggggggggagagacgggagaagacggagacagagagaaacaaataggagagacgacacgcagcacacaaaaaacaagacaaaacaacaagagaaaagagagggaggccaaacaacgagaaacacctgcccaccaaaaacacaacgagggagacgagacacaccacccgacaaataaaacacccgcggcgacagcgagcacaacacagcatcngcaccacaagaagcacaccacagagagagaagaacagaccacgaacgaagaaacaacgaaagaagcactaactacacagacagaggaaagaaaaaacaacacaagagagacgaaaagaaaaataataagaaacccgcacagaaacgaagaag

SEQ ID NO: 328800 - DNA, 5360 bp, Homo sapiens
ttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacgtttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttaataacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttgtaatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgataccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatca

SEQ ID NO: 328801 - DNA, 348 bp, Homo sapiens
ttgcctcttcaggcactgctgtaaggcaaacataaattgatccatgcaaagtgcttagaacatccaggcaccacaccacaagcactgttaaatgttacttattatgattattagataatcgactgctttggcatttcacccctactgcttatttctgcttacccattcatgctattatctgctggcaagtttcttgtgaaacagaagaaaggcagtaatgggtatcaaaggtttaagaaaaatgtactggggcgggttgctcaatgtaggaagatcaaacataaagtgaatactagtcattaattttattttatttatttatttatttttgagacggagtctcactct

SEQ ID NO: 328802 - DNA, 209 bp, Homo sapiens
catggttcctcatacttccaatggctgagattttctaaggattctctgggatgaattggtttgctttttgttaaaacccctgcccccaaccccaaacttaaaatgaattgttaccactctttcacctgtgttcctacttcgtttaatatggtttagaagtacacgtctcattgtttcatctaaaatatagttaccgtttttgtttacag

SEQ ID NO: 328803 - DNA, 402 bp, Homo sapiens
atgtggaaatgaaagatgaattaggcattctggttccaggcaaaatgtcagctttttttttttcctgaactcaaagtgactctcaaagtgctgggattacaggtgtgagcccctgggcccagcctcatttatgtacaaaaattaaacatccagccatatcttatgagatgtattaaacataagaatgtgttcatttgaaaataaaaggatggaaaaagatagatcaggcacatactaagtgaaggaaaacaagtgtctatatttttgtgagacttcaagtctataagaattatttagaatagagaagttcataataataaaaggttatttcaccaggaaaatacaagaattctagtcaggcatggtagcacattcctgtaatcccagctactcggatagctg

SEQ ID NO: 328804 - DNA, 2461 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328805 - DNA, 701 bp, Homo sapiens
cgcccggctaattttttatatttttagtagagacggggtttcaccgtgttagccaggatggtctccatctcctgacctcaggagatccgcctgcctcggcctcccaaagtgctgggattacaggcgtgagccactgaacccaccctacttattttttttttttccttctttgagatggagtctcactctgttgcccaggctggagggcagtagcacaatctcggggcactgcaaccttcgtctcccggactcaaaccatcctgcctcagcctcccgagtagctgggactacaggcgtgtgccaccatgcctggctaattttgtgtatttttggtagaggtggggtttcgccatgttgcccaggttggtcttgaactcctgacctcaagtgatccgcccgcctgggccgcccaaagtgctgcgattacaggcatgagccaccactcccggcctcaccctgcttttttttaaagcgtacatagaaaagtctttcagcttctagaggtcagtgggcggtgagggtctgtctgaaggaggcagccagcagctactgaacttctctctagtgttgtttaaatatgacttaatcgtgcttaagcaggccagtgcaaacatttttcttcctgctgcagcctgtttaaattcaaaaactcaggtgacttaactcctgcttcaaccacactcctgttaaccaccttcata

SEQ ID NO: 328806 - DNA, 2520 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcccatctccctacccccaccactcctagccgctggcaaccaccactctactctctacttcttgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328807 - DNA, 2441 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagcttgctcagggtccctttcctgcagtgaaacaccgactccttccgcagctccttggaaccggctcccggcccgagggcgatgggtgtcctggtgctcaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328808 - DNA, 2450 bp, Homo sapiens
cgcccggctaattttttatatttttagtagagacggggtttcaccgtgttagccaggatggtctccatctcctgacctcaggagatccgcctgcctcggcctcccaaagtgctgggattacaggcgtgagccactgaacccaccctacttattttttttttttccttctttgagatggagtctcactctgttgcccaggctggagggcagtagcacaatctcggggcactgcaaccttcgtctcccggactcaaaccatcctgcctcagcctcccgagtagctgggactacaggcgtgtgccaccatgcctggctaattttgtgtatttttggtagaggtggggtttcgccatgttgcccaggttggtcttgaactcctgacctcaagtgatccgcccgcctgggccgcccaaagtgctgcgattacaggcatgagccaccactcccggcctcaccctgcttttttttaaagcgtacatagaaaagtctttcagcttctagaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328809 - DNA, 1463 bp, Homo sapiens
atgggaaacctgatgctgttcagtgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328810 - DNA, 1867 bp, Homo sapiens
gtggcccagggggctgggaatatgagaatgtcaggacccctctgtccaaggtagcactaagctctaatgtaaactgtggttacagttgtcactactaaagggttaacatttattttgccccaaactaatcttaagtgcttttcgtgtattcttattcaagcctcacaacaaccatgtgaagtaggtgcaattattacccccattttagggatggggaaactgaggcacagagcagtagggagaacacttaaaatctactgtcttagagattttcaagaatacattgttactaatagtcaccgtgttgtacagtggatctcttgaacgtattcctcctgtctaactgaaatgttgtattctttgaccagcatctccctacccccaccactcctagccgctggcaaccaccactctactctctacttcttgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328811 - DNA, 1780 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagcaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328812 - DNA, 1555 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacaggga

SEQ ID NO: 328813 - DNA, 1272 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328814 - DNA, 340 bp, Homo sapiens
ctgaggcacagagcagtagggagaacacttaaaatctactgtcttagagattttcaagaatacattgttactaatagtcaccgtgttgtacagtggatctcttgaacgtattcctcctgtctaactgaaatgttgtattctttgaccagcatctccctacccccaccactcctagccgctggcaaccaccactctactctctacttctgtgagttcgactttcttggattccacataagtgacatcacatgggatttgtctttctgtgcctggctcatttcacttaatgtcctccaggtttatccatgctgtcacagatgacaagattccttttgtaagg

SEQ ID NO: 328815 - DNA, 511 bp, Homo sapiens
agagaatgtaaatctgcattgagggaacaagagacaaggaaaatgagatgatgacaacataagtaaggctgctcctagaatgcctgattttcaaagtaaagtcctgttaccatctcccaacagagctgtccagttctcccccaggaccctaccatcaggagccctacgtctgcaaacccgaagagcgctttcgggcaccccctattctccccccacatctcctccaggtcatcctgaacaaggacacggggatttccgtaagtatgtgggcatctgcccggaccatccgccgtgggtcatgttcagttgctttctttcctgtgtccacctcttgcaaagcagctggtgagcaagctcagtgtcaccccctagtgtgaactgtgccgttcacctctgctgtggggatgggctgataacaagaggttcccagtgtggacaccgctgcctcgtcttgcaaagcctttctgcactactcttccttgtccttcacgcctgcctcagtctaagccct

SEQ ID NO: 328816 - DNA, 300 bp, Homo sapiens
ggaaatggaatcgagatagcctcgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttc

SEQ ID NO: 328817 - DNA, 2420 bp, Homo sapiens
tcagtaagggagcatcagtaagcggagcggtcacgcctgctgggggtatgtcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328818 - DNA, 2635 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggacggcagaagagaatgagagcaagcaggggaaatgccagatgcttataaaaccatcagatctcatgagactcactcactgtcagagaacagcatggggaaaccgaccccatgatcgatacctccacctggtcctgcccttgacacgtggggattatggggattacaattcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328819 - DNA, 2252 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328820 - DNA, 1462 bp, Homo sapiens
cgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaata

SEQ ID NO: 328821 - DNA, 1909 bp, Homo sapiens
gcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtcccagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328822 - DNA, 3544 bp, Homo sapiens
  misc_feature (1429)..(1429): n is a, c, g, or t
  misc_feature (1909)..(1909): n is a, c, g, or t
tgcgtgtcgttccccttctctgggatgggaggcagctgccacgggcctctgaaagaggtgcctggaggcaaagacattgcaagtccgaacttcgttctgggccaagctgtgtgcccacaggagcgggcaaacggggctgagaagcagcaagaaggacaagctcgggtaggagaaaaggggcagaagaagagtgacactgtggcttccttgatgttgcagcacccctctacggcccctcccaatccacagagcctctgaccagcaccagtcttgctgcctgtgctgggggcacttggaacattggttagcaggagcaacaggcctggcactgccagctaggttcagggaagagagaaatgggctgagctgctgctcctggtactactgggccatggatgaaggcaccagactagaagtccagagccctagccaggggcggcaggagggaagactaccacttattgtgtacctattctgtgcctagccccgcaggaggcacttgaatgtttctcatttagtcacatacatttattgagcacctaccacatgccaggcattgtcctgatgggatgcagtggtgagcaaggttcctgctctcataacaaccctgggaggtaggccctattgtcatccccattttacagatgagaaaatcaaggctcaatacagtttcatgatttatcacagctagtgagtgtgggaggagggattctgggccctgacctaactcgtaagccttcgtttttcaggctacctttcatggccatgaccacttttctaatagcccccaggcttagccttgcctcctgggcagggctatggctgccccttttgttggagtgttggagaccctgcctcaacttgtttccacccatccctccaagccagagcttagccatataacaagagctcaggtaatgaaccctcctgggtgcaatgctgggtggtgacccagagtcaccttctccatcccctttgccctgacagccactcttttggggcaggcagatgaagagactgaggttccaagagtgtctgtcacttgcccaatatggagaggtacaaccagacagtcccaagaggccctggtaccttgccctggctcccaagggaggaaccagctgagggtagcatgtcctggccccaaagctgactgctaccatgctgtcccatgtctctacccactgttcccagtgaagactgaggccctatcccctgccaggggccaggcaacagggacacctttcttcttgcttctgggccaacagccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtcnctgaggaaattcccagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggaggagacccaagggcagggggaagaggaggagagagaagcagagacccacagactgccacctgtgagtgngcggggtcccagggatggcgaggaggctgggcccgaggggagccccgccttgccgccagggttaggttggggagggggagaggcaggactgaggccagtcttgggggcagaacgggagctgcacctcctcaagactctagggcccaggaagcatcagtggaccttggtttttgtcccggcttagccctaggtttccattgaccttcaacaaatcatttcacctttgtcagcctagcttttctctgtgtagaatgaggggcaggaggtccagcaaacattcagtcactctacaaacatttactgagcacttactgtgtgtcaggtacatctgtgagcaaacaaacaggattcctgcacattagtgtttaccttttagtgattaaaagtctgtcatcagctgagacgttatctggggccacttcctagtagccccggggaacatgtgcccctcgccactgtctcccaggagtatttttgcctgtgggtccccttgctgcttctaacccacttcgtaccttgtgggcagcagaatggagccccaggcctgagtgtggctgggagagaaggatgagaggagggaaaacccaaatctgtgagagtaaatagaaaaaataaaatatttcacgtgcacagtcaatcagtcactgaagagaggtggctctccttcaggggctaagcctcccccacgcacgtgactccaggaagtcatttcgtgctatggagtggagttgacccaagccctgaccccatgagccccactccatgaagacagggatcctggggactgcgccccctaggggtttatgctttcatctcttttctgggcccgcgcggcaatttgggaaacaagctggcagggaagtccatccaggcccgagttacccgccggcagccggaggcagaaagtgtcccgtggctcctgttcccaaggcagcagtcttcagacatttcactcgggaatctcctgaaagaatttcaaaagtggccgggcgcagtggctaacacctgtaatcccagcactttgggaggccgaagtgggtagatcacttgaggtcagaagttcgaggccagcctgaccaacacggtgaaaccacatctctactaaaaatacaaaattagctgggcgtgttggtgcatgcctgtaatctcagctacttgggaggctgaggcaggagaatcgcttgaacccgggaggcggaggttgcagtgagccgagatcacgccactgcactccagcctgggtgacagagcaagactccgtctcaaaaaaaaaaaagaattccaaaagcccatgtgctcccttgcccattcttaagttgacattgaacattttcatcagaattataagtcaagccaggctcagtacctcatgcctgtaattctagcactttgggaggccgaggcgagtggatcgcttgaggccaggagttcaagcctagccggggcaacatggcgaaacctcgtctctacaaaaaaaatacaaaaactagctggacgtggtgccatgtgcctatagtcccaactactcaggaggctgaggtggaatgatcacctgagcctgggaggtcaaggctgcagtgagccgagatagatccactgcacctcagcctgggtgacagagtaagaacctgtctc

SEQ ID NO: 328823 - DNA, 2280 bp, Homo sapiens
tgcgtgtcgttccccttctctgggatgggaggcagctgccacgggcctctgaaagaggtgcctggaggcaaagacattgcaagtccgaacttcgttctgggccaagctgtgtgcccacaggagcgggcaaacggggctgagaagcagcaagaaggacaagctcgggtaggagaaaaggggcagaagaagagtgacactgtggcttccttgatgttgcagcacccctctacggcccctcccaatccacagagcctctgaccagcaccagtcttgctgcctgtgctgggggcacttggaacattggttagcaggagcaacaggcctggcactgccagctaggttcagggaagagagaaatgggctgagctgctgctcctggtactactgggccatggatgaaggcaccagactagaagtccagagccctagccaggggcggcaggagggaagactaccacttattgtgtacctattctgtgcctagccccgcaggaggcacttgaatgtttctcatttagtcacatacatttattgagcacctaccacatgccaggcattgtcctgatgggatgcagtggtgagcaaggttcctgctctcataacaaccctgggaggtaggccctattgtcatccccattttacagatgagaaaatcaaggctcaatacagtttcatgatttatcacagctagtgagtgtgggaggagggattctgggccctgacctaactcgtaagccttcgtttttcaggctacctttcatggccatgaccacttttctaatagcccccaggcttagccttgcctcctgggcagggctatggctgccccttttgttggagtgttggagaccctgcctcaacttgtttccacccatccctccaagccagagcttagccatataacaagagctcagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328824 - DNA, 2191 bp, Homo sapiens
  misc_feature (809)..(809): n is a, c, g, or t
cgtaaatctaacgttcttcccacatcttcgccgtgtgcgaagactgtggatcatgcgaatactctagctagtgagtgtgggaggagggattctgggccctgacctaactcgtaagccttcgtttttcaggctacctttcatggccatgaccacttttctaatagcccccaggcttagccttgcctcctgggcagggctatggctgccccttttgttggagtgttggagaccctgcctcaacttgtttccacccatccctccaagccagagcttagccatataacaagagctcaggtaatgaaccctcctgggtgcaatgctgggtggtgacccagagtcaccttctccatcccctttgccctgacagccactcttttggggcaggcagatgaagagactgaggttccaagagtgtctgtcacttgcccaatatggagaggtacaaccagacagtcccaagaggccctggtaccttgccctggctcccaagggaggaaccagctgagggtagcatgtcctggccccaaagctgactgctaccatgctgtcccatgtctctacccactgttcccagtgaagactgaggccctatcccctgccaggggccaggcaacagggacacctttcttcttgcttctgggccaacagccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtcnctgaggaaattcccagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328825 - DNA, 1820 bp, Homo sapiens
gcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtcccagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagcacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328826 - DNA, 1531 bp, Homo sapiens
ctttgggatgcagcaggccaagggtctccaaaagcttctagcctcccatccttttccaaatgaggaaaactgaggccagagaggggtgggacctaacctacccagggtccagtgagtttttagtggtactcaggctgctctgagacagggcagagcatgtgcagcaagtgggaaggaacccagaggggcccctaccttcttgccatcacacttggcccaagagtgcagagctccaaggtacccccagctcacctctgcacttttctgtccatagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328827 - DNA, 1846 bp, Homo sapiens
gcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtcccagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328828 - DNA, 925 bp, Homo sapiens
gcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtcccagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctctctaaagatccattctggggacacggccctcaatacgtggtgacgttctctcacacacgttcgcaactacagcgaggctacggtaccgactga

SEQ ID NO: 328829 - DNA, 2811 bp, Homo sapiens
  misc_feature (1429)..(1429): n is a, c, g, or t
tgcgtgtcgttccccttctctgggatgggaggcagctgccacgggcctctgaaagaggtgcctggaggcaaagacattgcaagtccgaacttcgttctgggccaagctgtgtgcccacaggagcgggcaaacggggctgagaagcagcaagaaggacaagctcgggtaggagaaaaggggcagaagaagagtgacactgtggcttccttgatgttgcagcacccctctacggcccctcccaatccacagagcctctgaccagcaccagtcttgctgcctgtgctgggggcacttggaacattggttagcaggagcaacaggcctggcactgccagctaggttcagggaagagagaaatgggctgagctgctgctcctggtactactgggccatggatgaaggcaccagactagaagtccagagccctagccaggggcggcaggagggaagactaccacttattgtgtacctattctgtgcctagccccgcaggaggcacttgaatgtttctcatttagtcacatacatttattgagcacctaccacatgccaggcattgtcctgatgggatgcagtggtgagcaaggttcctgctctcataacaaccctgggaggtaggccctattgtcatccccattttacagatgagaaaatcaaggctcaatacagtttcatgatttatcacagctagtgagtgtgggaggagggattctgggccctgacctaactcgtaagccttcgtttttcaggctacctttcatggccatgaccacttttctaatagcccccaggcttagccttgcctcctgggcagggctatggctgccccttttgttggagtgttggagaccctgcctcaacttgtttccacccatccctccaagccagagcttagccatataacaagagctcaggtaatgaaccctcctgggtgcaatgctgggtggtgacccagagtcaccttctccatcccctttgccctgacagccactcttttggggcaggcagatgaagagactgaggttccaagagtgtctgtcacttgcccaatatggagaggtacaaccagacagtcccaagaggccctggtaccttgccctggctcccaagggaggaaccagctgagggtagcatgtcctggccccaaagctgactgctaccatgctgtcccatgtctctacccactgttcccagtgaagactgaggccctatcccctgccaggggccaggcaacagggacacctttcttcttgcttctgggccaacagccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtcnctgaggaaattcccagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaata

SEQ ID NO: 328830 - DNA, 636 bp, Homo sapiens
agctcattgaaagccaaaagcaatgttaagtgtacaagctttaaataacttacaaagttaatgtcatgaatgtaagtgctatctgaaacccatcactcagtgtttgctgcagccccaagctgtgataaaacaccactcataaatttatattaaaactctgctcgatagcaattatttaccaacaaagatttatcgactgcattagagactgggggtcttaaccaggcaaatcagtctttgttttgagtctcagggaccaaatggtgccggcctctgctcgcacagggatcatcgttacacagagggaacatttcatggctaagctcctacggggtgatggagcaacagtctcaacgcaggcggcgccatgtcaagatcagattatcaacaggcacgtccacaaccactcgcctttgctctgcgggcagcattcctcatcggctttaacagacaccgggggccgtgcatgcatctgactgaatgtaaaggacggtgcacgtgtgatttcgcaatgagatcaaatgaatcctcttgctgctgcaggagcactaatagtttcctaattaccaagttttttaaaaaaagttttttctggcttaaaacatccatgcagttcaaaatgttctacttctaaaa

SEQ ID NO: 328831 - DNA, 369 bp, Homo sapiens
tatgtcacagtcacagtcctccctggaattcaagtcagagtacaaggttacatgatttgtgattattgcaaacctcaatttccacatttgtgcaatggactgtcagtactgactgcttaggaattttttttcgaacctcttgtgattgaggctcagctattgaaatgccaagcccaggtcagagattagtcagaggaaatgctaaattagagcccatttgacttttatgtatgacactaattaaacaataacaaaaaaactccaagaactctagatagtttgtccaggggacacctataggttatgataacatcaaaaccagaaccaaaaaagcccaaatatttttcctgggaacttttttttcctcac

SEQ ID NO: 328832 - DNA, 389 bp, Homo sapiens
tcacatgactggctcatgggaacaaccttcccgagttcttgcttgttcaaaacggcctggacccttcaccatgaaggtcggtttggctgaagatgccagtcttaactccacttccttcccccagtgctttttagggccctaccgggcactgtctggagggtgggtgtgtgtgcagaagtctggcgatgtctgagttctcgatctcatcagtgactcactgtcattgccgtgtcttggtgttggccgttacagggcattttcgccaatactccgggtgcttgttgaacgtgttgctggacttcagggaagttgtctgtttgaaacgtgtgtttggttctgtttggttttctgcttctgggctgcagtgtggcgtgaggtggctttctctg

SEQ ID NO: 328833 - DNA, 387 bp, Homo sapiens
ttgagtactcaggacaatttaagtaatttaaatctatttggtggtttctcagaaggttaataacttgccttctgactaatgcattctacattgtgatttaaaaataagagctcttgagagtctactttgtgataggagcacttcttaataagtctgtcctgtcccaacttaaatacatttttcatctccaaaaaagttttatgccccatgttggccaacacattacgtgattattttggtttatacatcagtatatgttgttgttgttttgagacagtgtctcaccttgtcacccaggaatgcaatagcacaaacatggctcactgcagccttgacctcccaggctcaagttatcctcttgcatcagccctgcaagtagctgggact

SEQ ID NO: 328834 - DNA, 611 bp, Homo sapiens
gaatccacccccatgacccaaacaccttccacaaagccctacccgcaacattggtgatcacatttcaacatgagttttggaggggacaaaacgtttaaactatatcacaaccttaacaaaattttaagaaattaaaaccagctatttgtaaataattatcattataaccaaatgaaatttacctgaaactatatcattgatttaaaatctaaaatcaatcattacattcaccacattatcagaataagtaaaaaacaaaaacaaaatacaaaaaagactgtaactatcaaaaaatcaaaaatatttaaaaattgatcatttttggtgtcatttgattgaatcatttgatacgattcaatactcattgagttaagaactctcagcaacctagaaacagaagagaacttcctcattctataaaaggcatctgagaaaaatctacagaggacatcatacttaatgatgaaacatttagtgacttcttactgggatcaagaacagatgtttactattacttctgctattcaacattgcactgtgtaatctaactagtgcaatagtgcaaaacatagatcaaagaaacaaatattgaaaagataggagtgaaatta

SEQ ID NO: 328835 - DNA, 286 bp, Homo sapiens
tccctatgctacttttatcctttctgccttcaaagtagcaatgaccataagactgaagagaagaacatggttaggtcccagttttctacacacgttcaccctgggataaaacagaaaatctaaaactctgcataatccaaatgcaccattgtagaaaagatccttgtgttgtcagacaggtgcctaatttggtttctactcccttccctattcacctttggtaaatgagctcaaactgggcaccctggccaaaatgctggtctgcgaggaaggagggaggatgaga

SEQ ID NO: 328836 - DNA, 512 bp, Homo sapiens
acagggacaacctgctgcagaccgggtaggagggaggcaggggcctcttcccctctccttcctggcctggccccacacccaccagtgttggtttcactctgtggctacgattcttcctgggtgccctttccattgcacaactcctctaggctctacgaacagaacttctccccgcccccaagcctcttagggtgagacatgttgtcggtctgccattgttgctggtccctaaatagcagcaccctttgaaggatccttgaaccatgaccacaccgcaacaaagagtccttcatcaaactcgcttccaaatcccctcccaagaacaccttcagtttcctgcaagaaccctgactgctgaagccggattttgactaagcttctaccttgtaaaccgtgactgtgggattggggtcgaggcgcaatcagaggttgtataaggcactagatcaaggctgcctgtctgtcaggagtgtctgctttattcagtagtaaatgtgaattgtttttcattc

SEQ ID NO: 328837 - DNA, 691 bp, Homo sapiens
acagggacaacctgctgcagaccgggtaggagggaggcaggggcctcttcccctctccttcctggcctggccccacacccaccagtgttggtttcactctgtggctacgattcttcctgggtgccctttccattgcacaactcctctaggctctacgaacagaacttctccccgcccccaagcctcttagggtgagacatgttgtcggtctgccattgttgctggtccctaaatagcagcaccctttgaaggatccttgaaccatgaccacaccgcaacaaagagtccttcatcaaactcgcttccaaatcccctcccaagaacaccttcagtttcctgcaagaaccctgactgctgaagccggattttgactaagcttctaccttgtaaaccgtgactgtgggattggggtcgaggcgcaatcagaggttgtataaggcactagatcaaggctgcctgtctgtcaggagtgtctgctttattcagcatggtggatcagcacccaagaggagtcactactgactggccccacatcttcctgtgcccaggaggagtttgtggggcagggcctctgattatttttgaaaatctagtttaatttggtcattacattggtgtcaaaaatggaataagttaaatttcattgtacttcttaataaaaaaatttgaatggcataagtgccaatctcaa

SEQ ID NO: 328838 - DNA, 188 bp, Homo sapiens
gaagaatcaacagcagcagcttggaaaatgataacctgcaattccaagaatgctagtgtttactgcatcggtctaattttgtacaaaagacatataggaaacacctgatctgtgtcaagctctgtgtccagctttggaggaatgaagaactagacaagattctgactctccagtgctcctggtggaag

SEQ ID NO: 328839 - DNA, 372 bp, Homo sapiens
gctggagtgcagtggcaacgatcatagctcacttcagcctcgacctcccaggctcagccattcctcccattccagcctcctgagtagctgggaacacaggcatatgccaccatgcctggctatgttttttcatttttagtagaggcaatgtctcactatgttatccaggcttgttattttcttttatttgtagcctataaataataacttacggcctattcatggcttcctcttactaattattttttaaaacatcaataggctatcatggtagggaaattattgttcatttcttattcctttctttaaaggtctatgtaatttaaaaaattatttttagcaactgcatcttttgaaagttggccaaggaag

SEQ ID NO: 328840 - DNA, 481 bp, Homo sapiens
  misc_feature (131)..(131): n is a, c, g, or t
ccccaccccccttggggcccccccccccgggaaaaccaaaaaacctctttcccccccttttggaaaaaccaaaaacccccccttttttttgatggtttggaaaaacaacggggcttgggtccttccccctnggaaagaaaacaaggcggctgggccttgattccctggcactctgaccttttgagcacagcagagtggggacagtttcgagcagagctgcaggtgggagctgggccagtaggcaccagtcaaggagtgggcagggtaccagcagcccccgcattagcttcctagggctactgtaacatgtgaccacagactgaatggcttaaaccacagaaacctactgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328841 - DNA, 1501 bp, Homo sapiens
tctcctgcgtggtcccgggagaggaaggggcctggcccggggcggggtgtggagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328842 - DNA, 1700 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328843 - DNA, 1521 bp, Homo sapiens
tctcctgcgtggtcccgggagaggaaggggcctggcccggggcggggtgtggagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagtcggtcactgccacccaggcctgactggctgccctgccctcctttggcccgcagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 328844 - DNA, 1580 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328845 - DNA, 1805 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgaggtagcagcctgggccccagggatttgtaagcagaagctgagcctcttgggcccccattgccgtaccctgcatgggtggagctggctggggcggggctgacccaggagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328846 - DNA, 1020 bp, Homo sapiens
tatctgccactgactcaggcaactgcaaacgtcctcatgctcaactgtgggggaaaggggccctttccctcacagtgagaactctggggatgccttggggagtgaggcagacacatccccaacctcaagactcctggggaagaaagacaattaagccagaggctgtcctgaggagggatgatacagagcaaacggatcactggggcttctttgggccccagagttttctggattatttaatttcttccccctttatttttcttagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328847 - DNA, 793 bp, Homo sapiens
cgctagcggcattaagtgaacgggcctagctccgaaaccgcacaaaacgcgctgctaggagctgcattctgcaaagggaaactgggctcggggaacaaacctcagccccgatgcggcttggctcaggagcgcagcgcctgcctggttctcacctggcgttcacttaatgccgctaggcgctagcggcattaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 328848 - DNA, 1071 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaagagctagaacctcttctctccagatgagagacggtgtggattacgatggtgaatactgattgctctcatcctgtgagccttctgagtgcccctactgcaccagcacctcttaccaatagcaactcatttattctcaagggcgggcatcagtgcctgctttatacagatgaggaaactgaggcacaaggggtgacgtgccacagtaacaggaaactcttagcaagtggtggacctgggttctgagcccaaggagggtggtcccagaactgaggttccacacggaccacgcagcgatgcccaccatggagtgatactttgcagggtgtggggctcctgacgtgctcccctcacacgtgtgggtccctttcaaaagtggggtgagcataggatggagcaattcaacgactataggtcgccctttcagtaaagctctgtgtcatgagccctttggggggttggcggccacagttcctgcaacctcccttctaggagatggctcaaaagaaggacatgggcaggtacccagagctgtcaccctctctgtgttctctgaaagaaacaaatgaacaacagcttgcaaggaagcagcgagatgtcccagtggggaagggctttaggtgaactcattggaatttatgtaaccacaaaaacataaatgtgctgacaaagaaa

SEQ ID NO: 328849 - DNA, 466 bp, Homo sapiens
ccctcgtccttcagcagctccagcgccagggtgacgttgtgcagcatttctgcaggagagttgggagtgaggtagaattcctttaagtgcaggaagaagccttcaagttgtcctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 328850 - DNA, 909 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggtgtgtgcccacgcaggtctgagggtggagggtgaaggtctgtgtggcaagagtgagcctggccatgcctgggacttgcagcaccttcccagctgtcagctgagcgcccaattctgctcacccctgcctccaccttctgctttatgcttgacctaactcctcctcctgggaccttctacagagctagaacctcttctctccagatgagagacggtgtggattacgatggagcaattcaacgactataggtcgccctttcagtaaagctctgtgtcatgagccctttggggggttggcggccacagttcctgcaacctcccttctaggagatggctcaaaagaaggacatgggcaggtacccagagctgtcaccctctctgtgttctctgaaagaaacaaatgaacaacagcttgcaaggaagcagcgagatgtcccagtggggaagggctttaggtgaactcattggaatttatgtaaccacaaaaacataaatgtgctgacaaagaaa

SEQ ID NO: 328851 - DNA, 1294 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaagcacacctggcccagccctgtgactggcactggggacaccatctgtggtcttgcccggaagacctggtgaggtgctgacatgtcgtctcagctcggtctcctccacaggctgatccagagacaaggatttggatgccagtagttgagttgggaggttatcccaggggtcatgggagggaaggggccaacacatggttagtgatggagctggtcatggttctgggggctcaagcctgctgggtaccctggagccagcatagagcaagttcagtgcattcctgcccaaggggcgatggagctggggtatttatacaccaccacccctgccccgacaacctcctgacaacctttagtgaacagctgctccctgagaaagggctgggccttgattccctggcactctgaccttttgagcacagcagagtggggacagtttcgagcagagctgcaggtgggagctgggccagtaggcaccagtcaaggagtgggcagggtaccagcagcccccgcattagcttcctagggctactgtaacatgtgaccacagactgaatggcttaaaccacagaaacctactgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328852 - DNA, 1505 bp, Homo sapiens
gatctctccttctcgaaccctgctatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaagaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 328853 - DNA, 1467 bp, Homo sapiens
tctcctgcgtggtcccgggagaggaaggggcctggcccggggcggggtgtggagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 328854 - DNA, 1657 bp, Homo sapiens
gatctctccttctcgaaccctgctatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328855 - DNA, 1720 bp, Homo sapiens
cgggaaattccccgggggaatgttgctgaagatcctcttccctttccttcgataaccccctggctttatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaagcacacctggcccagccctgtgactggcactggggacaccatctgtggtcttgcccggaagacctggtgaggtgctgacatgtcgtctcagctcggtctcctccacaggctgatccagagacaaggatttggatgccagtagtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggaaaaattctgggaacttgacagggtcctgaggagg

SEQ ID NO: 328856 - DNA, 1207 bp, Homo sapiens
tctcctgcgtggtcccgggagaggaaggggcctggcccggggcggggtgtggagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaagaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagtagatagtcgtgaatcaaggatgccaagatgctacactgctgctgcatcttatgtcgtgttccgcagtcaatatcgc

SEQ ID NO: 328857 - DNA, 752 bp, Homo sapiens
cacgttcgctgtcagggtccatgtgctgagttcgctagcggagttttttccctctcatttgaggacgcagaacgcgcctaataggcgcgttctgcgttcactttctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 328858 - DNA, 905 bp, Homo sapiens
ccgagagtccaggtaggagtctcctgcgtggtcccgggagaggaaggggcctggcccggggcggggtgtggaggtgggaggacggcggtgcgggatggagggtggaggccaggctgacagggtgctggtggtgggttgcgggggtcgaccccaggctctggcctatgtagctgccattttggaggtgaacagcctgcggggaaactggcatggtttggggaaggcggggagagggggagaaatgaaagcattgagtttaagtggcctgcagaaccccgggggcccaggcggcacggcgggcgctggggctccgggcagagctttctggaggtttgtggcagcttcactttcacggcatccacccccctcgggccctgccgcagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggtgagttctggcatcggggccaccatacttgagtgttgggggtcacggagggaggggcccagacaccacctgggaaggatcccagagtgcagtcccagcccaggccacccggggaagggagtcggtaaagtgggaccttgagtccccacggcccctccggctgcccctgctcagaggctgctcggcgtcctccctccctgttctactgaggagttgccgcctctgaacttcagccaacccctccgtctccaggtgaagaaactgaggccctggggccaggaaggggcttgcccaggctgctgatccctttgggcagcatcgagtccaggccctccttgtaaccatg

SEQ ID NO: 328859 - DNA, 4228 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328860 - DNA, 6001 bp, Homo sapiens
  misc_feature (5094)..(5094): n is a, c, g, or t
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaagtatgttctgctgaatttttctgagcattggtgagcggacagcctacctgtaaaccatgacctccttgccaaacgttaattttatcagctcactagtaacctttgagaattatctggttgtcatgcaaagattgcactttctgaattatgttaaaacacatgttgtaaaatgagaactgctcatgctttgaaagaaaaccaggttcttcgtgcgttctgttgccgttgatttgaatggctgtgctgtatacgatgtgtccagaatgtcttcagagcactgtttccgtgtgatgttactacctactatgtgggaggaaaaaaggttataggttaaacaaagtcaattgactctatggtggtgtttctcaatacctgtgacgcacagtactgtgcgtcgtgactttctaagagaagtgtgcagcgggtgtgtcatcttgatatatgaaaccctggaatttccctcccctacacgcacgcaccgtccccgggggtccggtgtttgcagacatgctttgaaaagctgtctcagtgagacatcagttatgtccaaaatgagtttaccttagaatcagaccggttttgccaggcgtcatgtttgcaaacattatccacctaatcagattttgaaaggccggctttcatgtcgcctgcctgagactcataacagatccccattataagcgcgtttacacagcaaaatgattttattgagaaaaccagcattaagtactgttgccggctcagttttccattgcatactatctacttaaagtcccnttctcatttgtaagtgttccgatctttccccacggagaaaactgagcagagctgccgtgtcgcaggctttctgctgctgatgtcgcatctctttgctttcccctccttagtccatactccaagtaagtgaactcagactaccagcaactttttaactgaaaagtatctgtccatgatgatcaagatgcagctcttcgtgtttttattttgtctttttttttttttttttttggagggaaggagagacatcaactggacaaaatgcaaaatttggatgtgggacaattgctttttggagacgtgaatagctgtactgtacgtattattttgtgtggcatgctaactttgagccgggcactggcctaataaagtctttgtaatcctcccagcaatcctataaagcagacgcagatagtaaagattttaggctttgcaggccacgtacagactgtcacatgttctctgtttttaaaagtgtcaacaacattcttagctcaaaaacaggctgcaggtgggatggtgcccacaggccatagttggctgaccccggctagggtgtaggcacttagcattccactgtataaaggggaaacccaggtcatactgcgtgtgcgtgggtgggaagccggatgtggaatacaggtggtccctgagtctccaggaaccactgagctccagctgttcacacccacactctgcggcgcaagcaactacctcgccacggtttagccttggtctagcagcgactttaaccttgaatgttgcatttctgaaaaatttagaatctttaaaggacgtccctccggtgaataaaattaggcgcaattatagaatacatgtattatggccacgtagcaatgactgtattagggctctgctagttctgtaataaatagacccgaaaagc

SEQ ID NO: 328861 - DNA, 6248 bp, Homo sapiens
  misc_feature (5094)..(5094): n is a, c, g, or t
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaagtatgttctgctgaatttttctgagcattggtgagcggacagcctacctgtaaaccatgacctccttgccaaacgttaattttatcagctcactagtaacctttgagaattatctggttgtcatgcaaagattgcactttctgaattatgttaaaacacatgttgtaaaatgagaactgctcatgctttgaaagaaaaccaggttcttcgtgcgttctgttgccgttgatttgaatggctgtgctgtatacgatgtgtccagaatgtcttcagagcactgtttccgtgtgatgttactacctactatgtgggaggaaaaaaggttataggttaaacaaagtcaattgactctatggtggtgtttctcaatacctgtgacgcacagtactgtgcgtcgtgactttctaagagaagtgtgcagcgggtgtgtcatcttgatatatgaaaccctggaatttccctcccctacacgcacgcaccgtccccgggggtccggtgtttgcagacatgctttgaaaagctgtctcagtgagacatcagttatgtccaaaatgagtttaccttagaatcagaccggttttgccaggcgtcatgtttgcaaacattatccacctaatcagattttgaaaggccggctttcatgtcgcctgcctgagactcataacagatccccattataagcgcgtttacacagcaaaatgattttattgagaaaaccagcattaagtactgttgccggctcagttttccattgcatactatctacttaaagtcccnttctcatttgtaagtgttccgatctttccccacggagaaaactgagcagagctgccgtgtcgcaggctttctgctgctgatgtcgcatctctttgctttcccctccttagtccatactccaagtaagtgaactcagactaccagcaactttttaactgaaaagtatctgtccatgatgatcaagatgcagctcttcgtgtttttattttgtctttttttttttttttttttggagggaaggagagacatcaactggacaaaatgcaaaatttggatgtgggacaattgctttttggagacgtgaatagctgtactgtacgtattattttgtgtggcatgctaactttgagccgggcactggcctaataaagtctttgtaatcctcccagcaatcctataaagcagacgcagatagtaaagattttaggctttgcaggccacgtacagactgtcacatgttctctgtttttaaaagtgtcaacaacattcttagctcaaaaacaggctgcaggtgggatggtgcccacaggccatagttggctgaccccggctagggtgtaggcacttagcattccactgtataaaggggaaacccaggtcatactgcgtgtgcgtgggtgggaagccggatgtggaatacaggtggtccctgagtctccaggaaccactgagctccagctgttcacacccacactctgcggcgcaagcaactacctcgccacggtttagccttggtctagcagcgactttaaccttgaatgttgcatttctgaaaaatttagaatctttaaaggacgtccctccggtgaataaaattaggcgcaattatagaatacatgtattatggccacgtagcaatgactgtattagggctctgctagttctgtaataaatagacccgaaaagcaacaatggctcaaacaccatagaacgtttttgcttccataatattgggcaggggaatgggctggcagggcagcccttatgcaggcaggcatcagagcaacctgagccgtccatctccatcccgcctgaagtagcggggagcatggagggctgagaccatctgggagcttccatgagccaggtgtggaagtggcaccccttatgtccactcattttgcacggaggtgggaaacgtccagttgtgttct

SEQ ID NO: 328862 - DNA, 4716 bp, Homo sapiens
  misc_feature (4716)..(4716): n is a, c, g, or t
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaaaaaaaaaaaaaaaaaaaaaaaaaaaaaaaaaaaaaaaaaaaaaaaaaaacaaaaaaaaaaacaaaaaacaaacaaaaaacaacaaaaaacaaaaagggggggggggggaaaataaccccccggggggccccaatccccccttttttaaaaaagggggcccccaaggggcttaaaaaagggcgggcgggcaacaaaccaaggacgcgagggaaaaaaagcgtcggctacttatcaggagagacccccctcggggcgggggccaacgagggacaaccccccaaggaatagacgcccgccaacaaacacgtggtctagtcggaccccagccccttcgcgcgatattgttcacttatttattagccgggctgatcagtagcccagaaagcaaagtgaacgacagatagagaccgcgacatcatgacagacgtcaacacacgcaataagaactcacacacagatgatcgatcgaaaacagcagtcaccattcn

SEQ ID NO: 328863 - DNA, 4145 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacgcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328864 - DNA, 4077 bp, Homo sapiens
gctttacttttctaaagccagagagagagtgggggtggagggagcagggagggacccacgcagcacaatgtagacggagtccagatcagcattatttctcaaatgggttcaacggattttttttgcaacccctccgttatttggggaatcatcaatgattgaacactgtaaatttctcccggttgttttcccagaagggttgacgaaattaatgtggttcttctctctggctttgcaggttctacccagtagtgaactgcattatttgttaaggttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328865 - DNA, 1844 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaagttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328866 - DNA, 1295 bp, Homo sapiens
ttttcgttgtctagaggatcccatgggttacgctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328867 - DNA, 1130 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaagggtgagcatccgtgacacattatctgtggtcctgaagatttggtccctctgtgctgagaggcagtctga

SEQ ID NO: 328868 - DNA, 380 bp, Homo sapiens
gcaagtaagtctgaagccaggcagataactgttcctcagatttcagtacaactaatttagtattatattacaattcaaagactgctatttccattataattattataagagaatgaaccaattatatttttcttgttaagcaaactacatggtatgttagtgtaatgtgaaaaatagataactgaaagttttcaaatcttaattcttactgactttttgtttccagaaaagctttgacctggaaatactacgcaaaaaaaattctttactacctgcggcaacagaagatcttaaataatcttaaggcctttcttcagcagccagatgactatgagtcgtatcttgaagtgggtcttttcccatatatgtggacagtagta

SEQ ID NO: 328869 - DNA, 750 bp, Homo sapiens
ggcaggggtgctctctccttctctgtcttttcatatttaacatcttattatcacatctagaaaaccccagttccttaacttcatgcagtatctaatgagagttcctatttccccagttgtctcatatttttacatgtttggatcaggatttgttagtctcttggttttagtgatgtcagattggttagtcttttcctttacggctgtatttttagtgccttgttttaacaaaccttccctatcttgagtcatgaagatactttctattttagaagttctgcatttaacacctgagtctttgctgtactgagaattgaatttggtgtgctgttgtcaggccaggtccccatacctttttcttttgggtaaccagttgtcatctaatcactttttgttgaaaagtttattcttttccagataaagtgctatgttgataataagaggtgtttataaaaggggttaggggtgtcctgaaaaatgattcaccgtggagtaaagcaggtaactgaggatgtgagctgagaagccacgcggttgtctggaggttgttgcggccgggtctgcagggactgactgctcctcctgtgttaactaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagccc

SEQ ID NO: 328870 - DNA, 5946 bp, Homo sapiens
  misc_feature (5039)..(5039): n is a, c, g, or t
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaacatgacctccttgccaaacgttaattttatcagctcactagtaacctttgagaattatctggttgtcatgcaaagattgcactttctgaattatgttaaaacacatgttgtaaaatgagaactgctcatgctttgaaagaaaaccaggttcttcgtgcgttctgttgccgttgatttgaatggctgtgctgtatacgatgtgtccagaatgtcttcagagcactgtttccgtgtgatgttactacctactatgtgggaggaaaaaaggttataggttaaacaaagtcaattgactctatggtggtgtttctcaatacctgtgacgcacagtactgtgcgtcgtgactttctaagagaagtgtgcagcgggtgtgtcatcttgatatatgaaaccctggaatttccctcccctacacgcacgcaccgtccccgggggtccggtgtttgcagacatgctttgaaaagctgtctcagtgagacatcagttatgtccaaaatgagtttaccttagaatcagaccggttttgccaggcgtcatgtttgcaaacattatccacctaatcagattttgaaaggccggctttcatgtcgcctgcctgagactcataacagatccccattataagcgcgtttacacagcaaaatgattttattgagaaaaccagcattaagtactgttgccggctcagttttccattgcatactatctacttaaagtcccnttctcatttgtaagtgttccgatctttccccacggagaaaactgagcagagctgccgtgtcgcaggctttctgctgctgatgtcgcatctctttgctttcccctccttagtccatactccaagtaagtgaactcagactaccagcaactttttaactgaaaagtatctgtccatgatgatcaagatgcagctcttcgtgtttttattttgtctttttttttttttttttttggagggaaggagagacatcaactggacaaaatgcaaaatttggatgtgggacaattgctttttggagacgtgaatagctgtactgtacgtattattttgtgtggcatgctaactttgagccgggcactggcctaataaagtctttgtaatcctcccagcaatcctataaagcagacgcagatagtaaagattttaggctttgcaggccacgtacagactgtcacatgttctctgtttttaaaagtgtcaacaacattcttagctcaaaaacaggctgcaggtgggatggtgcccacaggccatagttggctgaccccggctagggtgtaggcacttagcattccactgtataaaggggaaacccaggtcatactgcgtgtgcgtgggtgggaagccggatgtggaatacaggtggtccctgagtctccaggaaccactgagctccagctgttcacacccacactctgcggcgcaagcaactacctcgccacggtttagccttggtctagcagcgactttaaccttgaatgttgcatttctgaaaaatttagaatctttaaaggacgtccctccggtgaataaaattaggcgcaattatagaatacatgtattatggccacgtagcaatgactgtattagggctctgctagttctgtaataaatagacccgaaaagc

SEQ ID NO: 328871 - DNA, 4249 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaagtctttctgtcttgttttgaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328872 - DNA, 4185 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctgcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328873 - DNA, 2862 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaagctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttacgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaa

SEQ ID NO: 328874 - DNA, 1777 bp, Homo sapiens
agcggactctcgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaaggtcgcttgccctgtctcagtgtgatggggatggtgtaaggggtttctgtgctc

SEQ ID NO: 328875 - DNA, 325 bp, Homo sapiens
ccatgctatcctgatctccgtcagtcctcgctggctgctccctcccagtccccttggctccttctttagactctcttctttgacttccaggtgctgacatgcccagggcccaatgctagcaacactttcttattcatgtgattttatccagtccgaagcttcagcatgccatcaatatttggaaagctcctaaatgtccatatttcccacctggaactctcccctcaactcccaaaacacatttccaactgctgattttgtctctacatgagaggtccctgtgtttacagggcagaaatgtagaccgtcccattctaagcggcca

SEQ ID NO: 328876 - DNA, 245 bp, Homo sapiens
atctagaggatgctgttatacaccctataccacctatgtggaattcatctgagatgagtggtatttgcactaatgccttaaacataacagtactagctggataatagccaccactgtggaggcccttaggcctaatgatgctaggagctttgtgcaagttattttggctgtcatttaaaaaaaaaaggccgggcacagtggctcatgcctgtaatcccagcactttgggaggctgaggtgggtgg

SEQ ID NO: 328877 - DNA, 1089 bp, Homo sapiens
tcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattcatcattcattcattcattcattcattcattctcattcattcattcattcattcattcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatatttta

SEQ ID NO: 328878 - DNA, 316 bp, Homo sapiens
tgaacttaatagcttcacaagaaaaatgttttatagtcatatacttgaccctatcagggaatagccacctaaaagcatgtgtagctggttacaaagtgcatcaagggagagaatggctggctctgaataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatatttta

SEQ ID NO: 328879 - DNA, 4617 bp, Homo sapiens
  misc_feature (659)..(659): n is a, c, g, or t
ctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctanccagcttctgaattcttacttgggtaccaccctgcggacaatggaagatgtcattgcagaacagagtgttagtggatatattgtgttttggttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttcttggcttgggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaatttgttatttgccctactttaagtaggtttattgtgttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatatttta

SEQ ID NO: 328880 - DNA, 4565 bp, Homo sapiens
  misc_feature (659)..(659): n is a, c, g, or t
ctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctanccagcttctgaattcttacttgggtaccaccctgcggacaatggaagatgtcattgcagaacagagtgttagtggatatattgtgttttggttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttcttggcttgggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagtttattgtgttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatatttta

SEQ ID NO: 328881 - DNA, 877 bp, Homo sapiens
  misc_feature (659)..(659): n is a, c, g, or t
ctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctanccagcttctgaattcttacttgggtaaacaacccaaagaaaaaggagaatcatatgaaacgaaatacaagaaaataagacatgggttcacaataaaaaaatagcccccgacaaatgaaccacgaccaagtaatgatgcgtaggactgtaatgacgactcggtaaggcccaaacgtgtcctacaaaacacatcggggaaccattactcacaccggttcc

SEQ ID NO: 328882 - DNA, 3072 bp, Homo sapiens
  misc_feature (659)..(659): n is a, c, g, or t
ctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctanccagcttctgaattcttacttgggtaccaccctgcggacaatggaagatgtcattgcagaacagagtgttagtggatatattgtgttttggttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttcttggcttgggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaatttgttatttgccctactttaagtaggtttattgtgttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttctta

SEQ ID NO: 328883 - DNA, 196 bp, Homo sapiens
ggtgccaggaggggtcgggtgctgcggcagtcctcgcgcagacctccgttttgagcacccccacccttgtttccaggggaccctgggccatgaggcgtggggtgcgtgcccgccaccaccatccgtgtctctgctgggaatggctccctggtggccgtccgtctgctcgccacgtcccacccccagcctgctgtcg

SEQ ID NO: 328884 - DNA, 1726 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328885 - DNA, 1550 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328886 - DNA, 1226 bp, Homo sapiens
attttcacaaactgaacatagctgtacccagcactaagaaagaaatggcaactattgtaacatcccaaaagctccccttgtgccttttccggtcattgtcttttcaggagttgccactatcctaattctaacaccatagcttcgttttgtctgagactacgttccttttaatataactgaactgtttaattcatctgagaattctacctatgatgaaaaatgttgtggtggtagcatttgggttaattctgattatagagtctcttggagagcaatgtccataaactaatcccaaacaacattgtctttttgatgttgtagtgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328887 - DNA, 1482 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagactgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328888 - DNA, 747 bp, Homo sapiens
ttggatagctgttctagaggatcccagtgtcatgtataccgaaataaagatgcttagccatttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328889 - DNA, 2205 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtaaaaaaaaaaaaaaaaaaaaaaaaaacaaaacaaaaaaaaaacaaaagaaaagtaaaaaaaaaaaaaaaaaagaggggggcggccgccgactaaaatacaatctcccccgagggggggcggcccacgaatatgaaccgcgtacaccccccctctcttgcgagagacacaaacaagaggggcgcccacccaatgaagagcgaggagcgaccacataacgatagacaggagaagacggaggagcgccgcgcgtgtagaaaaaaaacacgacccatcacgcaggcgggcagaaaaacgacgcgcccccgagggagaaccatcgagcggagcaacaagagaaacgccacaacagaaccggcggcgggcgcacacacactctcgggcacacccaccccgccataaa

SEQ ID NO: 328890 - DNA, 1804 bp, Homo sapiens
  misc_feature (1770)..(1770): n is a, c, g, or t
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaagtgngagtacaacagccccattcttagttaaaaaaaaa

SEQ ID NO: 328891 - DNA, 1548 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaactgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328892 - DNA, 1805 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328893 - DNA, 1648 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328894 - DNA, 2765 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaagtagatcagcattattaaagaaacggttcaactttgtttcttcccttagtattgctgacaaagtatctgctgtagaatacaggaattacttagaatagaaacatagtcatcacaactgttactaaatggaaaagaaaagaattattgagttaagtattcctgtcaatacgggaaacactgctagtaccttatgttggtgttagacctctctgccctacactgagaatatagttttacacaggagcaaggtttgtgaagcagcatagtgaggtagctaaagccatgggctggctctaaaggctttaaatcccagccatgtggcttagctgccatgagatgtgcatttgagaaatgttgtcttcttttgctgttcaactccagattttcagatgataatgtgattatcccagcttaagttgcgtccacttctggtctagtgaattgtggaaggcagttttagagaaaggagtcatgagtaacatgaacagcagttggctatgtctttccagttctctgctgatgtcagaaagacccagaaataccaaggagaaaaagccatcttagggatctaaggaggccctatggaaagttactaccttagacatttgaagatagcttactgcttagtacatacactgtaaacaacgatctcattttaaatgagaactttctcataaatattttacaaatgaggtcaaactagcataaagccatttaaagagattatcagtccaatatgaaccagttaagtctttggactatccc

SEQ ID NO: 328895 - DNA, 623 bp, Homo sapiens
tcgctctagaggatcctagaggctgaatgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgta

SEQ ID NO: 328896 - DNA, 1300 bp, Homo sapiens
tgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaagtaagttcactctgaattgtgagatagtgaattttcttgatattgttttaggagtgtgtcttttgagcaggtggggttatgaaaactgaatacccacatgaaagtgattaataatgccttttttttttttcaagaacttttctctgtgtaaaagactggtgtagttatggttttacaaccatgtctggaacacattgaaggggcctaggctaggaacagggattgatatagtag

SEQ ID NO: 328897 - DNA, 469 bp, Homo sapiens
taagacatgggtttccagagtttagagtctcactatgtgataggtgaaagctgtgttgttgatgaggatttgcacagcctcctcccggttgcctgctactgaccatcccatttcactgtgggcagctccagtgggtaagagggttcttcacagtgtggtgagctactcctttctagcctccatccattttttgctgttcttctggaagctatataggcttgtctattggactttatagtcttcaaataattgaagatactaaaatgactattatgtctaccctgctctgctacacacataaatcttgtccagacaaataggtctgtttaccagtactttctcatcagaagtcatttgaagacacagaaagtaaaaaccacaaagaaaaaaaaaactatattaaagtgaaagctcaacagtaacaccccataaccatagcaaaacaaaacaaaacaaaacaaaacaaaac

SEQ ID NO: 328898 - DNA, 406 bp, Homo sapiens
gacaggaagaaaatattagagctgtcattaagctgttctaagaaataagctaaaatgtactaatatttaatatttgattgaaactgggaaccttgctcatgtcatctgtcagatgacaagtgtcctattttgaatgcagctatcctgggattatgtggaacttccatagtgcaaagggtcctgcattcccttgtttgctttcagcctgttgtgacatgctacatttactcatcagacttacagattatgttaaccagttttaattaaagcaacagctgcaaaattgacacttggcttataaagattcctacagagaattatgggttgaaggtaacgtagataatgcaaataaaaatgagccgtaaatagttggcagagctgagacttctcccagtacaagctatga

SEQ ID NO: 328899 - DNA, 310 bp, Homo sapiens
acagctagactacatttcctgaccactcttacagctggatatggccaagtaaccaagttctggacaatggaggtaaagtgtggctgttctaggcccaaactggtgaaaagtgaatgattcccctctgtgctttcttctctcccccaactagttggatgcagagggtagtccctaaggcatggaatagtcagaagatagaggaagtttgggtccctgagagagacacagacttctactatcttatgacactttaatcttggctacaggctaggcatggtggctcaggcctgtaatcccagcactttgggag

SEQ ID NO: 328900 - DNA, 805 bp, Homo sapiens
ggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaata

SEQ ID NO: 328901 - DNA, 981 bp, Homo sapiens
attaactgaaaatggatcagagacctaaatgtaaaatacaaaactgtaaaactcttaggcaatagcataggaggaaacctagattaccttttgtgtggtgataatattttaggtacaacagcaaaggcatgatccatgaaggagagaattgataagctggacttcgttaaaatttaatacttttgttctgtcaaagataatgtcaagaaaaatttaatacttttgttctgtcaaagataatgtcaagaaattgtgatgacaggctacagactgggagaaaatatttgcaaaagacacatctgataaaggaccatcaagcaaaacatacaaagaacgtctaacattaaataataagaaaatgaagaacatgttctagaaatggacagaagggcaaaggtgggaggatcacttgaggcccagaattggagaccaacctgggtaacatagcataatcctgcctctccaaaacattaacaaataaaacatgagcagggcatggtggtgcatgcctgtagtcctagctactctagagtctaaggaggatcgcttgagcccaggaatttgaggttatagttagctttgactgcacttcagactgggtgacagagtgagaccctgtttcaaaaatactaaaaaaaaaatttttttaagggcaaaagacctggctggacacctcaccaaagaaatacagatgacacataaacatatgaaaatacattcaatatcatatatcattagggaattaaaaattaaaacatcaatgaggtattaccacatacttataagaatggctcagatccaaaacactgacaataccaaatgttgatgaggatgtggaacaatagaagcgctcagtcattgctggtggaagtgcaaaatggtccggtcacttgggaagacagtttggcaggttgttatacaactgaacattttctaaccgtacgaaccagcagctacactccttggtatttacccttatga

SEQ ID NO: 328902 - DNA, 673 bp, Homo sapiens
tctctcacgaagcatgactcacttggtaactttaaaggagtcagttttatttggtctcagtttctctgccactaaaatgggttttgtgatatacgtagggaaagacaaggccttctgattaaacattctgaaatctgaaacgggatagtattaatttttttggttgggtgctgtggttggttaaaatgaccaactattttgcagcccctcctttcaataggttgattctattctcctactctttgaagctgagttgccttatgacttgcattaaccaatgaatgtggtggaagtgacgttggagagttctagacttaagcctcaagaagccttgcagcttccaccttccttctcttagaatgttccctttaccagctaagaatgcaaaaaagaccagctaggtttctgaacaacaagagaccgtagtgaagaagggaaagctcagccaacagtcagcaccaaggtcctggacttgtgagtgagcccatcttagaccctacagcttcacttgagccacccgataatggcagccatgtgaatgtctacaggaagaccagcagaataactgtccagctgagcccagcccaaattgccaacccacagaattgtgagaaataataatggctgttttaagtcactaaactttggggtggtttgttagtttcccaggact

SEQ ID NO: 328903 - DNA, 523 bp, Homo sapiens
ttaaattttaagtttctcaaagggtgtccattccctgctgctaatattttcttcactatagatgtctttgtgagaaggtttggtacttttcaaaacctgttggtcttagaaagaagaaggtaagaattgtgaaaagctgattgcgactggtgcccttgtaggtcaataatgtctattttgatgtggcctgaatatttcacttcattttatatggtcggatgctccatgttaggattaaggggtaattaatagtaatgtatgtggaattcagtgtgagttgattcattcatctgattctgtatttaatatctaaatgggatcagtgacactggtaggatgggtgagagaagaaaattggctaaaattgcatcatggaagatcaggcttggatggggtgccataggtgggcctgaggggcaacatgagatcccaggagcacaaacttagaggggtgttgaaagataccaagacaaactgtctgctttaacattttgccaacagcccttctgagcctcaagaaaaa

SEQ ID NO: 328904 - DNA, 315 bp, Homo sapiens
gttgtggcatgtattggtacttcattcctttttattgctgaaaaacagttttggtgaatgttcattttcattttgggggatatctatgtgggagtagagttactgagtcataaggtaactctatatttgtgattttgaggaaataccatattgttgcttgatgttagctgcagcattttaaattcccaccagcaatgtataagggttccaatttctctgcatcctccctaatacttgttattgtctggcttttaattatagttctcctatctcactgtggctttgacttgcatattcctaatgactcaatgtaag

SEQ ID NO: 328905 - DNA, 112 bp, Homo sapiens
ctcccaaagtgctgggattacaggcatgagccaccacgcctggcccaatcttttcttctctccatatcgagtgatcttccttaatctctagtgctttctccttgttctcagg

SEQ ID NO: 328906 - DNA, 198 bp, Homo sapiens
gcggccgcctactactactactgctcgaattcaagcttctaacgatgtacggggacatggccacactgtcagtgagtgttctttaggtggtaggactatggttgatatttttcttcttcctatcttcctgcctttttcagattttcaatattaaacttgttattcttacattggaaaaaaataaattgtttttaaaaa

SEQ ID NO: 328907 - DNA, 2583 bp, Homo sapiens
cttctcagaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaa

SEQ ID NO: 328908 - DNA, 2926 bp, Homo sapiens
cttctcagaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaaggttaattactagggtttagttatcagcttgtgagtgctaatgggaagcatcccttaggacccccacttactggccgtagacaaaggaggaagccttaattcacaggccaccaagaattgagtaattacttcttagaaagctgcagccagtctccctgtgcttggtggcgttgtgctttcttctttctagctaatgaaaacataactgttgagaaatgtggttccattttgaaggggcttcattttattctgttggttaatgacttcatgtcatctcttctcctgccccctcactccttcatacagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaa

SEQ ID NO: 328909 - DNA, 2621 bp, Homo sapiens
cttctcagaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaa

SEQ ID NO: 328910 - DNA, 2029 bp, Homo sapiens
cttctcagaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttacccttttttgcccttacagatacttccctctgcttagaatgtccttcctctattgtccacctagaaaacttttccttcatatttaatatcaaatataatctgctttgtgaagccttccctgactcccttaagcatatttaaaggtcgagc

SEQ ID NO: 328911 - DNA, 472 bp, Homo sapiens
tgtctctatgtcttaaaagaagcaaactcaacttcaaagtattcatcaatatgactgtaagggtgcattaggcaactcatgcaaagttcaaattgtgaaacagattatgttttaattacaagataatgaaatggtcactatatttaatttttaaagtattgtttctgaattatacaggctgccatgaaacaccgtctaacttctaggtcaagattgaagattttgtctttctttaaaacaaaaacttcagagttgtaatatcaacattttgaaatagcagtctacttcaaatataagtctaaatatcagggaatttccttccctagcccctcccaatttaagttctttgaggtaaagacaaatggatgcccagccccacacccctttttccatagcgtgggtgtgggtctcagcccctttctagccacattctatctggtgaatgaggatccagctctcataaaagctccca

SEQ ID NO: 328912 - DNA, 468 bp, Homo sapiens
taaaaagtagattttcatacccaaattgttccaacattcttaaaagttctttagtcacactggttcatttcaggggtttaataaccacatgtggctagtggcttctatattggacagcacagctgtatactgtcagcataactagagtaaaatttcatcttggaactgacagtgacaaatgtgtgattacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggt

SEQ ID NO: 328913 - DNA, 4662 bp, Homo sapiens
  misc_feature (2190)..(2190): n is a, c, g, or t
  misc_feature (4655)..(4655): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328914 - DNA, 4343 bp, Homo sapiens
  misc_feature (1871)..(1871): n is a, c, g, or t
  misc_feature (4336)..(4336): n is a, c, g, or t
gcctttgtgtatcgtactttaatcctttacatgtctctgatggatatatacatatatatatatataatttttttttttttgagacagagtctcgctctctcgcccaggctggagtgcagtggcgccatctccgttcactgcaagctccgcctcccgggttcacgccattctcctgcctcagcctccccaatagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328915 - DNA, 4635 bp, Homo sapiens
  misc_feature (2190)..(2190): n is a, c, g, or t
  misc_feature (4628)..(4628): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttatcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328916 - DNA, 3614 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggt

SEQ ID NO: 328917 - DNA, 3860 bp, Homo sapiens
  misc_feature (2190)..(2190): n is a, c, g, or t
  misc_feature (3853)..(3853): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328918 - DNA, 3610 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaacctctagcctagccgtttactcaatcctctgatcagggtgagcatcaaatcaaaatacgccctgatcggcgcaatgggaagccagtagcccaaacaaatctcatattgaagtcaccctagcaatcattctactatcaacattaactaataaagtgggttcctttaaaccttttccaccttttatcaaagaaagaaacactctggattaattcctggcattatgaaccttgggcattaaatatgattttatcttccacatta

SEQ ID NO: 328919 - DNA, 3365 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagtacgaggttgttttacaagcaacggacgagtacataacgacctggagacagacggagacacgaccttggctaggcgac

SEQ ID NO: 328920 - DNA, 3222 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaatttctgcacgacttttttgcatttatgtaagccaggtacgcgggagacaatgagtaca

SEQ ID NO: 328921 - DNA, 2331 bp, Homo sapiens
  misc_feature (2324)..(2324): n is a, c, g, or t
ttcgtgtttttgtctcatttgtttccatcagcaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328922 - DNA, 1722 bp, Homo sapiens
  misc_feature (1715)..(1715): n is a, c, g, or t
accgatgaagatgcgtttcggagggtcaacccctttgaaattttcttggaagacgaatgggtggtggtagagattctgaagaaatggaaatagatggtgatccttttagtgccttggtttcagcatgaatggatatcccgatgaagatgccgttttcgcagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328923 - DNA, 1516 bp, Homo sapiens
  misc_feature (1509)..(1509): n is a, c, g, or t
taaaaagtagattttcatacccaaattgttccaacattcttaaaagttctttagtcacactggttcatttcaggggtttaataaccacatgtggctagtggcttctatattggacagcacagctgtatactgtcagcataactagagtaaaatttcatcttggaactgacagtgacaaatgtgtgattacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328924 - DNA, 1358 bp, Homo sapiens
  misc_feature (1351)..(1351): n is a, c, g, or t
aaattaattatacaatctcctccccttcccttcctgaaaatacatggtttgtggaactggcttctatcctagtaatactgtttgcatgctgcaaagctaaggaaacaatgacctgtgatcccaggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328925 - DNA, 4349 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggtaggagaatcaactattacagcatccggcaaacaactggaattgaccagaaatgccttcagaattaggtctttttgaatcataagcacagccatttaaaaaaaattttttaacctagctttttgagtattttcaacattcgttgtagcatctcacactgaaaaaataaatagtgagatctggaatgtatatagaagaaaagaaaaatccattctgtttggtggttggtagggttaaagccttgagcacttgatgcttatactgtatgtaaacaaacagaatttcttaaggtaaaaatatcctttttgacataaagagtatttttcatttttataaggtgattggcattagtctcaaggattgagtttctagtagaggctggtctttcagacctggctttttcagggctggaaagcttttggctggtacaccagtttgaatcgctacccatagttatttgtcttttggatttagtagttgaccttctaactaagactcatttctctacagtgaaaaagagaaaaacgttttaatgtcacctcaaagaaatgcagagtgaaggttgaatgaaattaatttgaagtatcagactagatatgtacaacgagaagtgcatttctaatccttagtataagagataggatttctgaaacttagcatgtttcatttaagtgatcagcctaagatatcaaaattggatgatacacttcaaatcttttagtttagaatcatcttaaatttcattcaaaaaagtttaagcaccaaaaaatgccaataattataaaaatgacttactaaagataaaaaatccaaaagtcaaatactacattggaatgtagtgttggtgagaatttatacaacccagaatggctgtaaagtttttaatacctggtttttgtttgctgtattcataaataacaagtgccttctattaatgtaacttcaaaaaagccctctcaccctgtagtcaagctggaactgaaagcttgtagctatcaaatgaatgtctatcttgataagcatattgcttagcttgataggttttgtttgtctaaatttttcattgtttctgcataatatgtacttcataagcatatcaagttttatgtgccatgcatatttcatggtatctgaaaaagaattctgacaaagtgtgtgtatgtatgcatttcacaatgcatacaatttttatgtgcatcaatacatgtttttccctggcctaaacatgttgtttcacagtgtaatggatggcaaggttttcaaatgataaagaacatttcagtttaaacaatgaacagaatcaatcatggatcttaatgttaatgcagcaattttttcacgggcagtaaacaagaatgattgcatttaatagctctatacagtcacctcttgattatctatgttaatggaatagaaatgataactataatattacagtaatttgtcttttggttttgtgtaagtattttgctcttaacttggatgtagctgtgggggattctcagttaaaaaagtgagattgttcgatggagactaggaagagaaagtgtactccctatctgaagtcactcatctgtttcttcccattccttcttggcgaatgttaagaactgaacatttggcgtggacactagctacatagtagattaattatagagagttgttggacatggaaaatttggtgttttggtcctttgtggacatttactttgtattattgtcctcttaacaccaaattgaagtataatcaaactgctatatgaagaagggcctagaaaatgtggaggttttacactacttgccctgctttctatatctagtttaagctgttaggactcaatggctctgattttgaccataataaaagcattttgattttaaa

SEQ ID NO: 328926 - DNA, 451 bp, Homo sapiens
ggttcagatcctgctgcagataatcaagtgttgactgtatgtgtaatggtaattgagcagaataagagggtaccaggtaatgtcctgaacttgagacggttgatatataaccatatattttcaatgtatgggttactgtgtaatattttatttgttcttgcagccaggttgtcaaagcattggcaataaactgctaagtaaaacatttaaaaattatgtgcttaaagtcattttcttttgaacatttctgaatttgcagtgatagctattttcagtgaagaaaatatttggacgaatagaagaaaggcgcattagaattttttaagggactctcttttcagtttgccagtgaactccttacagttgaataatgaatgtatttaactctttcgtaggcatcctctggtatcacgattccaaaacccccaaagccaccagataagccgctgat

SEQ ID NO: 328927 - DNA, 387 bp, Homo sapiens
tgtctcagattcattcttaaggaactgagaacttaatcttccaaaatgtcaagtaagtttcaatttttatatttatcaatctatgttaataagagactaatgccctagcaagtgggaattccaaaatactctcatttttttttcttcaaaacaggaccattggtagttttgttgcatagtattatatctcagttgtttacaagaagttatttattttctttcaaacagaaagaccatcttatgccccacctcccaccccagctcctgcaacagtaagttttaattttcttgttaatgtaatagccaactctggccttgatacaaaaacccagatgtcttccagtgacagtcactcaatcatcacagcaacaggatgaaattcagctt

SEQ ID NO: 328928 - DNA, 4922 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaggtctcagtgtttttaatgcactacatatttgtatgcaagacaagcatccagtttttttctgtaatgcagtgacagtgtggaatgaccactcagccattataaatttgtgtactcagggcccttgtctcacccaactatctctataaactgctgcagtagcttatttgtacaagacacttgtgaaaatcagttttcttacattatagtcattgtcacatatggaagttggtctttgattccaaaagtaaagggaatatgtttctacattaacaggaatatggagaaatctgtaacgtttg

SEQ ID NO: 328929 - DNA, 4380 bp, Homo sapiens
  misc_feature (1908)..(1908): n is a, c, g, or t
  misc_feature (4373)..(4373): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgagaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328930 - DNA, 4822 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtactagcacacaactgaaactctctacaacaaaaaaggggggggggtttaaatttcttgagggggccaagttaggttaccagtttttgtaaaggggcccaaaggaggattaaagcacggaggcgggttaaaggtggagggaacggctgggattggaagacctttgggggattgcacactcagatagctggataataggttgtgaaagattcggggagagcgata

SEQ ID NO: 328931 - DNA, 2471 bp, Homo sapiens
  misc_feature (12)..(12): n is a, c, g, or t
  misc_feature (23)..(23): n is a, c, g, or t
  misc_feature (2464)..(2464): n is a, c, g, or t
aataggctagtncgggctgggtngtgaatcggccgaggacgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328932 - DNA, 3502 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaaggaaacagcccagcatgactttaaacaaagtgtctaaaagaccaaccttatattatttctacaactgctttctcctcgtttaatcc

SEQ ID NO: 328933 - DNA, 2424 bp, Homo sapiens
  misc_feature (2417)..(2417): n is a, c, g, or t
acccactggggcatagaagtcaatgggggaacagaaagaggaaccaatgaaactgagaacttaatctgccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328934 - DNA, 1738 bp, Homo sapiens
  misc_feature (12)..(12): n is a, c, g, or t
  misc_feature (23)..(23): n is a, c, g, or t
  misc_feature (1731)..(1731): n is a, c, g, or t
aataggctagtncgggctgggtngtgaatcggccgaggattgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328935 - DNA, 1661 bp, Homo sapiens
  misc_feature (1654)..(1654): n is a, c, g, or t
caacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgaggcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaaaaaaaaaaaaaaaaaaaaaaaaaaaaaagggngggggcg

SEQ ID NO: 328936 - DNA, 2949 bp, Homo sapiens
  misc_feature (2190)..(2190): n is a, c, g, or t
gaaagggcctctgtcacccagggtggagtgcagtggcatgatcatggctcactgcagccttgacctcccaggctcaagcgatcctcccacctcagcgtcccaaataactgagaccacaaatgtgcaccaccgcacctggctaattttttttttaagagatggggtctccctatgttgccaggctggtgtttcttaatttttcaaatctttggtagagaaagaaccaagcgaagaaaatgagtcattcatttatttactccacaagtattgagcatctaaatgtgctgtgtactgttccagatgtcaaaatctccaccctgatgggaaaaaaaagacggctgggtgcggtggctcatgcctgtaatccagcactttgggaggccgaggcggtggatcacttgaggtcaggagtccaagaccagcctgaccaacatggtgaaacctcgtctctactaaaaatacaaaattagcagggtgtggtggcacatgccgtaatcccagctacttgggagctgggaccacaggcgcccgccgccacgcccggctaattttgtttttgtatttttagtagggacggggtttcaccgtgttagccaggatggtctcgatctcctgacctagtaatctgcccgcctcggcctcccaaaagagctgggattacaggcgtgaatattttttaacaagcaatttcatgtacattttctcaagcaccactcaagctgcctgtccacggggcagacgacttctcctttagtctttctcttgaatatgctcttcaatttcattaatctctattcatgagtataacaatattggaaaaattggacagagtatcacttgttcctcgctttgcagactagagatgcttctagtccctgttggcacactcaggatgggggctacgggaagcccaagaattcagcctctctctaaatgtcaactgttttccagtaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccaggtggcacccgcggcgctgcaaggacacacaagctgttgcgagggggtcaactctccgggccttggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttattttttctaaagagggtcgggtggggcccggaaaaaaaaaaaattaagaagagtgtggaaagtgcgagtgcggaagcnccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgataaaagaaaaaaagtggggttttgtttatgctttctctgtgagttaagatatgagaaatctcttaagtataagtttttatttcttatcctaaatgg

SEQ ID NO: 328937 - DNA, 692 bp, Homo sapiens
tgaaatgaattccttagtcaaaaacaatgttgtatgggatatcatgatggtgaataacaaattatttaagttcactcatggtagtaccagcagaaaaattgcaaatgtaaaaggctgctcaacatgaatatgcagacgaagacctttatgatgatccactttcacttaatgaatagtaaacatattttctcctccttatgattttcttaatagaattttcttttctctttctttaagaatacagtatataattaacaaattatgcattaattgtttatttgatcagcaaagcttgcagttaagaataggctattagtagttaagtttggggatagcccagagttatatatggattttcaactgcacaggagctggtcccctaacccttgcactgttcaaggatcaacagtatttacaatactatacattttattcatattttagagtgtagtacttctactcatgaaaaataattaactataaaacagcgtcgggaaggtctttcaggagttcttccagaagaaagccttgttatcatagaagatgacagctgcatatatgttattgcccttgaagaccctgaagacctttcactgggacaagatttggagatggaagacagtgatattgattatcctgacccttacagggctaagctagtgtgtgtgtttgtatcttagtttttaacaaaa

SEQ ID NO: 328938 - DNA, 371 bp, Homo sapiens
  misc_feature (130)..(130): n is a, c, g, or t
aatgagaaatttataaaaaagttttattaagtgcgttaaccaccagagtttttcccatatcaacaatttttaaaaaaaaacgaccagtaaagcgcattaaaaacacccccaatataggggaaaatggaanactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 328939 - DNA, 4868 bp, Homo sapiens
acagcgccgcgtgcgccccgggcgcgccgtagccgcggggcccgggccgggcgctacgctacgaaggcagcgtaaggcgggcgccggacgcgggcaggggccggggccggagccgggtcggggcgcaccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagacagggagccaggatgggaaccacggactgacctgacctgcgtcctcggggccactgcactgggtgattcacgtgtgcccaggccctgaggtgggccggacctgggagtggcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 328940 - DNA, 4754 bp, Homo sapiens
acagcgccgcgtgcgccccgggcgcgccgtagccgcggggcccgggccgggcgctacgctacgaaggcagcgtaaggcgggcgccggacgcgggcaggggccggggccggagccgggtcggggcgcaccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 328941 - DNA, 3539 bp, Homo sapiens
acagcgccgcgtgcgccccgggcgcgccgtagccgcggggcccgggccgggcgctacgctacgaaggcagcgtaaggcgggcgccggacgcgggcaggggccggggccggagccgggtcggggcgcaccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacagtcccgttcctttaccataggattctccacagtggcttccgactcaggctccaatggaccaaataaaagcgttttgttttgtaa

SEQ ID NO: 328942 - DNA, 3432 bp, Homo sapiens
acagcgccgcgtgcgccccgggcgcgccgtagccgcggggcccgggccgggcgctacgctacgaaggcagcgtaaggcgggcgccggacgcgggcaggggccggggccggagccgggtcggggcgcaccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 328943 - DNA, 5410 bp, Homo sapiens
  misc_feature (5077)..(5077): n is a, c, g, or t
  misc_feature (5410)..(5410): n is a, c, g, or t
acagcgccgcgtgcgccccgggcgcgccgtagccgcggggcccgggccgggcgctacgctacgaaggcagcgtaaggcgggcgccggacgcgggcaggggccggggccggagccgggtcggggcgcaccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagacagggagccaggatgggaaccacggactgacctgacctgcgtcctcggggccactgcactgggtgattcacgtgtgcccaggccctgaggtgggccggacctgggagtggcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaaaaaaaatgaaaaaaaaaaaaaaaaaaaaaaattgggggggctttatagggggggggggaaaaaagggttattgaaaggtgacaggggacaaagggggttctctgagcccaagtttcttggcacagggggaaacatcagcggggagccccataagaggggcgcaataactcgaaaaccagcgtaccgtgataagtcgaccagagacaagnagcgaacaaagaagagagggggtcacacacttgggaaccacacagtgggggcgacggcgacagaataatatagtacaaaattcacttttatgtcttacacaaatccttaacttacaagtatgtattatatttatatatttatattacaaatcattaataaagataataaataggtagataataaacaaaagagagatattagagaatcaataaagatcaggaacttaaaattcagaatcagaggatacgtagaagtatcgaggtaaaggatagaagatatataagaacgaataagaaggtagacatattagagataaaatggttctagccgtn

SEQ ID NO: 328944 - DNA, 1984 bp, Homo sapiens
acagcgccgcgtgcgccccgggcgcgccgtagccgcggggcccgggccgggcgctacgctacgaaggcagcgtaaggcgggcgccggacgcgggcaggggccggggccggagccgggtcggggcgcaccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 328945 - DNA, 687 bp, Homo sapiens
  misc_feature (7)..(7): n is a, c, g, or t
  misc_feature (570)..(570): n is a, c, g, or t
  misc_feature (598)..(598): n is a, c, g, or t
  misc_feature (625)..(626): n is a, c, g, or t
  misc_feature (645)..(646): n is a, c, g, or t
  misc_feature (655)..(655): n is a, c, g, or t
  misc_feature (658)..(658): n is a, c, g, or t
ggatccnccgggctgcaggaattcggcacgagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaacagactggagnccagtcagacagccagcagagagtggangcagtctgcgctggttacactgcatgnncacgacagtgagcatctcnncttttctgnaancttgtgacagacagcagtatagcggctga

SEQ ID NO: 328946 - DNA, 2116 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328947 - DNA, 2239 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328948 - DNA, 2062 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagaataaaaaaaattgttctga

SEQ ID NO: 328949 - DNA, 2130 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaatagactaacgtcattgcccagctcccatttgcccgatactgaggagaatctcaatgaatgcccttggcttacggtccagggggatccg

SEQ ID NO: 328950 - DNA, 1987 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328951 - DNA, 2064 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctttccacctccgcctccatttctttcttgatccagtccacgtagttgagcactttggtgtagaagccatagccccgaaaaaa

SEQ ID NO: 328952 - DNA, 2263 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328953 - DNA, 1954 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328954 - DNA, 1757 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccctgtagctccctcctcccatctccttcccccagcccaataaaggtcccttagccccga

SEQ ID NO: 328955 - DNA, 1955 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccctgtagctccctcctcccatctccttcccccagcccaataaaggtcccttagccccga

SEQ ID NO: 328956 - DNA, 296 bp, Homo sapiens
acttttaaaataaattctctcctatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328957 - DNA, 2041 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328958 - DNA, 1084 bp, Homo sapiens
  misc_feature (47)..(47): n is a, c, g, or t
  misc_feature (67)..(67): n is a, c, g, or t
  misc_feature (84)..(84): n is a, c, g, or t
accttcatccagaaactcacccccacaaagagaaatttcaatggaanccctcgacccttcacgactnaagaacgttcctttttncttccgaggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328959 - DNA, 2065 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328960 - DNA, 1244 bp, Homo sapiens
  misc_feature (7)..(7): n is a, c, g, or t
ggatccnccgggctgcaggaattcggcactagcggcacgagctgttctgcctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328961 - DNA, 1981 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacgcccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328962 - DNA, 812 bp, Homo sapiens
  misc_feature (52)..(52): n is a, c, g, or t
gcaaatttaaagttgaactaagattctatcttggacaaccagctatcaccangctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttccctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccga

SEQ ID NO: 328963 - DNA, 2035 bp, Homo sapiens
ggctggtacggcccggaagtagggatcaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccactgtagctccctcctcccatctccttcccccagcccaataaaggtcccttagccccga

SEQ ID NO: 328964 - DNA, 748 bp, Homo sapiens
tctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgcc

SEQ ID NO: 328965 - DNA, 2108 bp, Homo sapiens
atcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttaaaaagccttttgggggcagtaattggc

SEQ ID NO: 328966 - DNA, 227 bp, Homo sapiens
actcagtgctgtgttagagagggagtgggacaagggcaagcagaaatgacatgaaattttctagcatttccttggttgcttcagcttcttagcttgtttcaagagttctcacaaaactaatcgcttaaagatgttcctacgggcttgttgctgttgatgttttgttttgttttgttttttggtctttttttgtattataaaaaataatctatttctatgagaaaaga

SEQ ID NO: 328967 - DNA, 2147 bp, Homo sapiens
atcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaataaataacacctcttcccctaatcatcactctccatctaccctaatcccaaaaaaaataaacctcgaggtgg

SEQ ID NO: 328968 - DNA, 2026 bp, Homo sapiens
atcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttaaaaagccttttgggggcagtaattggc

SEQ ID NO: 328969 - DNA, 2002 bp, Homo sapiens
atcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaaga

SEQ ID NO: 328970 - DNA, 2333 bp, Homo sapiens
  misc_feature (2228)..(2228): n is a, c, g, or t
atcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatcaaaaaaaaaaacaataacacacacaccacgttgtgggcgcacggccacgggaccgcgcaaaaaggcttcaggaagaccattcgtggggccgcgcgggccccaatggtaggcacccggggcccgaggtgccctgagaaacccgggcgcgacncggccggcgtcgccaccaataaaacgcccggggaccgagcgcgtcgaccaccccacggcgggcccgcagcacccgggccacacaccggacccagagcggaatatc

SEQ ID NO: 328971 - DNA, 2181 bp, Homo sapiens
atcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaaaacaacacaaaaaacaacacaaacaaaaaaacaaaaaaaaaacaaaaaaaacaaaaaacaagagagggggcaaaccacaaaaaaaaaccccccacaaggggcgccccacccaacaaacaaacaacaacaaaaaaaactgaaaaaagggagagccaaaaaagaaaggcggggttgccgc

SEQ ID NO: 328972 - DNA, 1981 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagtta

SEQ ID NO: 328973 - DNA, 750 bp, Homo sapiens
  misc_feature (732)..(732): n is a, c, g, or t
  misc_feature (736)..(736): n is a, c, g, or t
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtctttgctcctataaatgaaattgctgtctcaagtaactgattgtcttgtggtattaaataaatgcagacgtgatatatacaanacanaaaacaaaaaacct

SEQ ID NO: 328974 - DNA, 887 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaagtgagttctgatttttcaagatgcaagtcaagggactggtcagtggcgagcccctgagctcacagcagtaacatctggaactcctcagcccttcctggggcatacactgcctttacctagaaactttcaggtgaccctcattaccgtaagaggactgtttcttttcttttctttcctttttttttttttttgagatggagtctcactctatcactcaggctggagttcagtggcgcagtcttggctcactgcaacctctgcctgctgggttcaagtgattctcctgcctcagcctcccgagtagctgggactacaggctcccaccaccatgcccagctaatttttgtatttttagtagagacgcggtttcacaatattggccaggcttaactcctgactttgtgatccacccacctctgcctcccaaagtgctgggattacaggcgtgagccaccgcgcctgtccacagaaggcctgtttc

SEQ ID NO: 328975 - DNA, 880 bp, Homo sapiens
taatctgttgtttgctaagaaacattacctagcttatcgaaattgtatataaaataaaatttgatagagtttcttgtccctaaaggctttcctgtgcagggaagaggtagggttttgtgatggctgtttcaaccataaaaagaccttttgtttcctcagttgctaaacatttgcctagacacttgcttatggaaaagtggggtattattgtttttaagaaagtaatagattaatagttgaataacaaaaaatgctttatatctggtattttttaaaaaagcttcattgactaggttccaccactagttagtttcctttttaaaaggtttccttagtgcttttatagtatgagggaattgcaggaataagaccacaaacatcttttcaaaaagcacagctatggacaaagcaaggttcacctacatgcactaaagtctccatgagctcagatggacctgacaactcacttcatcggtgtttgtttcaatatccaagattcttcttttacaggtgtttgatttcaccaccatagacttgacatctgagactgatgaaattccagatattatagctttggaagaggagaacggatcaaataattcacatgctaatggccctgtcctctcagggcaagatgttgaataactaacaacaataaaataccccttttggttgaatacgcaatttgtattacattaaacttcctgtttttattcctgtgactttgaagagtgttaatctattttttggctacattggtcttaattgcaatgacactctgatctaaacttttgtaagagatcctagttctgtgtcatataatcatttaatataattaaagtttaattgctgaaatacttataatgaaaattgggctgta

SEQ ID NO: 328976 - DNA, 826 bp, Homo sapiens
taatctgttgtttgctaagaaacattacctagcttatcgaaattgtatataaaataaaatttgatagagtttcttgtccctaaaggctttcctgtgcagggaagaggtagggttttgtgatggctgtttcaaccataaaaagaccttttgtttcctcagttgctaaacatttgcctagacacttgcttatggaaaagtggggtattattgtttttaagaaagtaatagattaatagttgaataacaaaaaatgctttatatctggtattttttaaaaaagcttcattgactaggttccaccactagttagtttcctttttaaaaggtttccttagtgcttttatagtatgagggaattgcaggaataagaccacaaacatcttttcagagctcagatggacctgacaactcacttcatcggtgtttgtttcaatatccaagattcttcttttacaggtgtttgatttcaccaccatagacttgacatctgagactgatgaaattccagatattatagctttggaagaggagaacggatcaaataattcacatgctaatggccctgtcctctcagggcaagatgttgaataactaacaacaataaaataccccttttggttgaatacgcaatttgtattacattaaacttcctgtttttattcctgtgactttgaagagtgttaatctattttttggctacattggtcttaattgcaatgacactctgatctaaacttttgtaagagatcctagttctgtgtcatataatcatttaatataattaaagtttaattgctgaaatacttataatgaaaattgggctgta

SEQ ID NO: 328977 - DNA, 895 bp, Homo sapiens
cattctggttgaacagaacgtttgtcagaacaattatggctttcttcctgaagtgtgcttggccggaaaagaaagcaggagacctcaagggctaataatctagcagtggctgacactgaaatgatgcatggaagaaaggctaccaagcaagggaggtggagagcagtttgaagcaactggggtaaagtccggagaagaagctggtgagaaagagacaggagccagatgctgaatgacggtaaatcgaatcctggagggaaccaaacaaaaccctgaaaacctccaggaatctcaggttggccaaatccttggtaatgtcctgccactccccaggactgccacactgtacacaccctatctaatggcaacctactgcaggggccaaggaaaaacgtctcctttgtcctctggaggttcactgaaaaatcaactggcggaaagcaaattaacaggtcaaaagatatacatgtattattataaaaagacgtaaatgtattattgggcatgtgggggaaccacagagtaattactccacctctcagtgggctcagaagcttatatacccctcctgaggttacagaaagtttgggggctcagagaatggtggtaaatcaggatttagtggcaagacagaaatggaaacttggctagcaaaagtcatttcattatgtagatgggggtccccaaactttgggccatttacactgtggccatttacattcctgttaggaatagggccgcacagcaagaggtgagtggcgggtgagtgagcaataccgcctgagctctgcctcttgtcaggtcagcagctggtattaggttctcttaggagcaagaacgccgctgtgaactgcacatgcaagggatctaggttgcggctccttatgagaatcta

SEQ ID NO: 328978 - DNA, 310 bp, Homo sapiens
ccagtacggtatggtgctgggccagtcgaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacatccgtactggcccgcatgtgtctctgacttgatggcactgcagtggcttcagagagggtcgcaaataccatgccacagcgcccggggtttgcctgaag

SEQ ID NO: 328979 - DNA, 2009 bp, Homo sapiens
  misc_feature (1982)..(1982): n is a, c, g, or t
  misc_feature (2000)..(2000): n is a, c, g, or t
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttanaaaaaagaaaaaaaaaanaaaaaaaaa

SEQ ID NO: 328980 - DNA, 2030 bp, Homo sapiens
tacgagggctggtgttaattcggccgagggtgagtgcgcgcccagtgggtgccccagcgaaccggtcccgggcccccagcggcgcccagttggggtggggggctccccggggccttgggaccgctgctctgctccccgcggggctcaaaggtggacgggacgcgggggtgatggtccgagaccccccgctcgcctcgcggcttccagatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagtta

SEQ ID NO: 328981 - DNA, 2061 bp, Homo sapiens
cattctggttgaacagaacgtttgtcagaacaattatggctttcttcctgaagtgtgcttggccggaaaagaaagcaggagacctcaagggctaataatctagcagtggctgacactgaaatgatgcatggaagaaaggctaccaagcaagggaggtggagagcagtttgaagcaactggggtaaagtccggagaagaagctggtgagaaagagacaggagccagatgctgaatgacgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagtta

SEQ ID NO: 328982 - DNA, 1753 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtgtttgatttcaccaccatagacttgacatctgagactgatgaaattccagatattatagctttggaagaggagaacggatcaaataattcacatgctaatggccctgtcctctcagggcaagatgttgaataactaacaacaataaaataccccttttggttgaatacgcaatttgtattacattaaacttcctgtttttattcctgtgactttgaagagtgttaatctattttttggctacattggtcttaattgcaatgacactctgatctaaacttttgtaagagatcctagttctgtgtcatataatcatttaatataattaaagtttaattgctgaaatacttataatgaaaattgggctgta

SEQ ID NO: 328983 - DNA, 838 bp, Homo sapiens
  misc_feature (820)..(820): n is a, c, g, or t
  misc_feature (824)..(824): n is a, c, g, or t
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggtgagcttgggacaaaagtgctgagacttgacacttcacatgttttcatcttctatctgttaaaacaagctgtacatatcacaaacaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtctttgctcctataaatgaaattgctgtctcaagtaactgattgtcttgtggtattaaataaatgcagacgtgatatatacaanacanaaaacaaaaaacct

SEQ ID NO: 328984 - DNA, 635 bp, Homo sapiens
  misc_feature (403)..(403): n is a, c, g, or t
  misc_feature (437)..(437): n is a, c, g, or t
  misc_feature (439)..(439): n is a, c, g, or t
  misc_feature (450)..(450): n is a, c, g, or t
  misc_feature (453)..(453): n is a, c, g, or t
  misc_feature (456)..(456): n is a, c, g, or t
  misc_feature (460)..(460): n is a, c, g, or t
  misc_feature (462)..(462): n is a, c, g, or t
  misc_feature (472)..(472): n is a, c, g, or t
  misc_feature (478)..(478): n is a, c, g, or t
  misc_feature (497)..(497): n is a, c, g, or t
  misc_feature (503)..(503): n is a, c, g, or t
  misc_feature (526)..(526): n is a, c, g, or t
  misc_feature (538)..(538): n is a, c, g, or t
  misc_feature (556)..(556): n is a, c, g, or t
  misc_feature (564)..(564): n is a, c, g, or t
  misc_feature (567)..(567): n is a, c, g, or t
  misc_feature (608)..(608): n is a, c, g, or t
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatctcagtatagtctcagnagtccgtctaaaattgtcagattgtctcaaatancncttaatgtccntgntgnaggngngactgagtancagagnatgtggagtggagtagaanctgtcnctaattttctgtaaattcagacncattcaaaactncagaaatttgatgtgtcncaaaatgnccnaaaagtgtcgcactgttggtaactgagtgtggcaaaaaagnatgtactggtgtaacgtaactaacctg

SEQ ID NO: 328985 - DNA, 2100 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttaaaaaaaaaaaaaaaatcggggtctaggcggggggggaaaagaggttggagggcctgggctagtgttctgaccaggttttgtaaggggatgggggccaaaggggggataatgaacagagg

SEQ ID NO: 328986 - DNA, 1889 bp, Homo sapiens
  misc_feature (1862)..(1862): n is a, c, g, or t
  misc_feature (1880)..(1880): n is a, c, g, or t
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaanaaaaaagaaaaaaaaaanaaaaaaaaa

SEQ ID NO: 328987 - DNA, 1624 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgtgttgttgtcattgttgttgtttatcgaagccatcctcaattgtgtgaggtgtgtagcttgaagatcctctaga

SEQ ID NO: 328988 - DNA, 1743 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagcacagtgggactcatcaggatcatcatagtccaacggcatccatggagcacactcgtaccgcaatgaggagctaacagacaagacaccctcagaccacacagcgccaccgccgactccacgagaacaaccacacaatgacaacagacgaaagaacaagaaaaacacggtacaaccacagcgacagaaggcaacaacacaccgaacggatcgacgcgtgaacaaggaagcaacaagcaagcgaagcaacgccggccgcgcgcagcacaaaccagacgacgccgcagtggcagcccacccagcgtaggacaccagcaccaggacgcggatactaccgacagcgacgacacgcaaccgcggacgcaccagccgcaggaaaccgccgaaacaccaacgcagagcagacaaagggagaaggacaacaccccaacacgccaccacacagtggctgaagcaccggcacggtggccccgtagaaagaaactggaagccacagagcgcggacgaccgagagacaaacacacggagagacacacgaagtgaggcacgacagcactcatcagcgccgaaagacgaactcgacaacagcgatcacacacaccgcgccgccgaaagcacagaacccgacgacaaaacagaaagggaagtacacaccgaagccggccgctaccacgagcaacaggacacggagcgcaacgccagctccacacgggctgggcgcgctgacccaacgcagcagagtcgccaaaccggcagagaagccaaaccacacgcaccaaccaaaccgagcaggcacaacgaccacacaa

SEQ ID NO: 328989 - DNA, 468 bp, Homo sapiens
tttctaacatgaagcacttcagagttctattactttcaccttactgtaccaaaaaatactttttttttttttgagaccaagtttcactctgttgcccaggctggagtgcagtggtgtgatctcggctcactgcagtctttgcctccccggttcaagtgattcttatgcctcagcctcctgagtagctgggattataggcacgcggcaccacgcccagctaatgtttgtgtttttagtagagatggggtttcaccatgctgtccaggctggtctcgaactcttggactcaagctatccacctgcctcgcctcccaaagtgctggaattacaggcgtgacacacccacccggcccccagaatactttttacactaccaggaatatccacctataagccctcctcttgtactccatagcaccttgttacgagaccgctagctcctctgccttttttttatttttatttttt

SEQ ID NO: 328990 - DNA, 503 bp, Homo sapiens
ggcgccttttatcacaagagaaacatgtgtgtatctgcttgcctgggtgaaaaacctcgagatgcgccgttgtctggcaacacaagacagcatgtaagatctacgatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 328991 - DNA, 1368 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 328992 - DNA, 974 bp, Homo sapiens
gcgaccaccgcagcggacagcgccaagtgaagcctcgcttccctcccgcggcgaccagggcccgagccgagagtagcagttgtagctacccgcccagacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 328993 - DNA, 1200 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctgtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 328994 - DNA, 1284 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctcccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 328995 - DNA, 1342 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 328996 - DNA, 1641 bp, Homo sapiens
  misc_feature (1472)..(1472): n is a, c, g, or t
  misc_feature (1546)..(1546): n is a, c, g, or t
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctagaattccataggttccactaactctatttcggatgacaaactggtttgtcttttttttctttcgaaaccttatgtttcagatgaatttaaaggtagtcccggtttttcatttccagacacaaaaagagacaagggnttcctcttttcaaacggctttagaatattcttgtgttcagaatctctttcaaaatgtggaggtgtggatgtctntgggggtgcccagaatgagggttacatcatcccggtctcaaactctccccccatggaaaaggttgtttcctaaattaaccatctggctgatggag

SEQ ID NO: 328997 - DNA, 1311 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacgcggactatgacttagtaggcgttacaccctttcgttgactaaaccttaccttgcgc

SEQ ID NO: 328998 - DNA, 947 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtgagccccgctcgccctcgccccggcccc

SEQ ID NO: 328999 - DNA, 848 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggactaaatggcagccatttactccatgcaggtacagactgccctaatcttgctacctcgagacgcgtctg

SEQ ID NO: 329000 - DNA, 1497 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 329001 - DNA, 510 bp, Homo sapiens
ccgggccctgagccagccaggagggaagatcctggtgcattgtgctgtgggcgtgagccgatccgccaccctggtactggcctaacctcatgctgtaccaccacccttacccttcgtggaggccatcaagaaaagttccctgtgcgaattcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 329002 - DNA, 374 bp, Homo sapiens
cgccccgagcttctgctcacgctccccgccgcggtccccaggtacttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 329003 - DNA, 1072 bp, Homo sapiens
ggtcggtccgcgacaggcgactccccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 329004 - DNA, 958 bp, Homo sapiens
  misc_feature (20)..(20): n is a, c, g, or t
  misc_feature (47)..(47): n is a, c, g, or t
  misc_feature (107)..(107): n is a, c, g, or t
  misc_feature (170)..(170): n is a, c, g, or t
  misc_feature (175)..(175): n is a, c, g, or t
catcggggcgaggcctatantacggatcatttctctactcagaaacntaaacatcggcattatcctcctgcttgcaactatagcaacagccttcataggctatgtcntcccgtgaggccaaatatcattctgaggggccacagtaattacaaacttactatccgccactnccttncgaattcggcactgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 329005 - DNA, 1382 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccattggccagcgggggtataagctc

SEQ ID NO: 329006 - DNA, 1455 bp, Homo sapiens
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttgatcttcatgttgcagtgtgcttcccggaagcacactgcaacagcgtcatgacagggggacttggcaggacaccttgatccaaggcgacagcatttggcaaggacacggaagttgggtcgttgcatccatcatcaggagttgacttgttctgagcaactgaacagaa

SEQ ID NO: 329007 - DNA, 1130 bp, Homo sapiens
  misc_feature (1094)..(1094): n is a, c, g, or t
gcgaccaccgcagcggacagcgccaagtgaagcctcgcttccctcccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatctcggcatgctcataaggaaaggttaaaaaaagtaaaaggaactcggcaaatnttaccccgcctgtttaccaaaaacatcacctctagt

SEQ ID NO: 329008 - DNA, 869 bp, Homo sapiens
ggagggcacacaccccttctgtactgcacctgtagtaaccttgtttgactctgtaaataaagcttcttgaggacagtgtatcatttttgatctgctagaacatttggtacaattgctgttcacatggtaatacctcaaaaatacttagtgatcaaaatatgagtcatgaatatatggcgatgaaacttttttttaaaaaatcagacattcagaatattgttctttcaggttgtactgaaagtcatacttttattcttctagtgcccctcctttagtttgacagttccttttggaattgcttttgaggcagtaaaagatccttttgaatgtttataagggaagcaaacttctgttgagacctattctgagtttaggaaataacccaaaggcatttgctttctggttttatgagttagaggatccaatttgggtaatggattttgtgttaaaaagaaaaaaaaaggtgggattataagtaatttccaaatgtggttctaatagaagtgtaagaattgctttaagtgctggcagcagacttgttcagttgagtctttaagcttccaaggctgtaataaaggtaagaaggggccacagggggaacccaggggagaaagtgctggtgtaacctgccagaaccaggctgagttgtaaatggggaatacttatatcctctgtccccatatggatatggcacagggaaaacgttctctaggagtcggtctgacacagggcacggtgtgtggagtcctggcacattaggagactacagatgtagaacagcatggctggagcacagggcacagtgagaggatgggctgcagacacaggaactggcagggaggatggacacagggtcttctgaagaggtc

SEQ ID NO: 329009 - DNA, 4883 bp, Homo sapiens
aagaggaatcggctttcagccttctggagaggggaagacctcgcccctcaacttcctcgtgcctagacagtggaacggggtggagcccctccgctcctatctccagcagacagaaagagccctccacctcagaaagatccagtttgggggggaggggaactcccccaagggggaagagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaagtgaactcttatgggcacccacaagctccccacctctaccctggcccatcaccaatgtacccaatccccacccaggactcagcaggatacaatcgcccagcacaccatatggtccctcggccatcagtgccacctcctggtgccaatgaggagatccctgatgacttcgactgggacttgatcacttagtgcatcacagagtgtggacatcagcccagggccgcgtggtgaaatctggcagtggggaaagagcaaccccagcccgtcccttccccccgtctgtatatagacatatatcctctttttgttctttctctgtcagagaagccactgcaagatgctgccgaagataaccctctctttcctgcctcattcttctctcttccttcctgttttttcctagttcttttattattattcttatattattattattattattggttatatactgtccatagtctcctgtccctacatcatggatcatgtccaccttttgctaatttaaaatcatcaggctggaagatgaagccatgatagctacagagaaaggttttagactccagtttacctttctcttggagaaactcaatgctaatcccaccttttggccctaaattgttttttgttcccatcagtttcaggccaggactggagaggccacattaccaagtagaaagggtctgaaacattacttggcagccaagaatttggaggttttaaaatggtgctaattctgtcctctgaggtcttccttgtccctttataccttcaatccttacttctgccagtctgtatttcctatcaagggtgaaagtgatgatggtggtgcaggagggtgacaataaaatcctagtggaattggagaccattggaagggatggaatataagtcagtgtgaaactgagtatacactgccatgttacatcagtgtccattggcttgttttgagcctgttctctaagaagataggattggttttagcccaaactctgcttctatggtagggcatgaggacaactattcagcatggttttagcttcttggagatgattccaacttaactattttggctttttaaacataattttctctgaaaattaattgtggctcttatttgcatttacgaatgatcttcccatccctttttcccattcagcaaatattagtttgtcctcctttaattgtttgcccaaatcttccacccatcttttttcttccctcattttctgggattctcaagaaagaaaaagtaacccattatcactctgagtttcgtcgtgccctgagacatgatgggaatctcattcccacctctcatagcagagccaaacctttagtgttggtggtaggaggatggggagaggaaaaaagagctggcaaagaaatggatagggaatattttagttctttaaatatataggcagatgcttctcttggaatccagatcatctggctgaagcttttgcaagtaggctttgaggggtgaaggagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaacctgactccctttgggcctcagtttcccctccccttcatgaaatgaaaagaatactactttttcttgttggtctagcattgctggacacaaagtgtagtcattattgttgtattgggtgatgtgtgcaaaactgcagaagctcactgcctataagaggaaataagagagaaagtggaggagagggacaaaaggagtaattatttggtatagatccacccatcccaacctttctctcctcagtccctgctcctcatgtttctggtttggtgagtcctttgtgccaccacccataatgctttgcattgctgcatcctgggaagggggtatatggtctcacaagttgttgtcattgtttttttgcatgctttcttaataaaaaaaaaaaagaatgtttacagttttatct

SEQ ID NO: 329010 - DNA, 2675 bp, Homo sapiens
  misc_feature (2604)..(2604): n is a, c, g, or t
aagaggaatcggctttcagccttctggagaggggaagacctcgcccctcaacttcctcgtgcctagacagtggaacggggtggagcccctccgctcctatctccagcagacagaaagagccctccacctcagaaagatccagtttgggggggaggggaactcccccaagggggaagagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaaggtactgcaccaagccagttgccatggaggtggagactatgttgaaaaggaagcataggagaaaggcaaaagagaactgagagaaaggattttatggggcagtgacccaaattgagcagtggaactagttatcagttgactgaatatctgttgaatcagtgaagtcctaaactgaaaaatgcaaaagaaatagactgtatgattcctttttagacctcagtttgggagatcagaattgtttaagaaaagggaggagatttgttagagaaaggctgtattttaaatttgcgtctcagtaatccctaccgcctgggtgataccggatgaaatggtggttcttgcttatgtgatgttcaaactagtgaaatgagagagatgtcatgattatgttcctgtttcttgctttttgtttttgagatggggtctcgctctgtcgcccaggctctggagtgcagtggtgtgatcacggctcactgcaaccttgacccctggagctcaggtgatcctcccactttagcctcctgagtagctgggactacaggtgtgtaccaccatgcccagctaattttttttttgtantttgtgtatagctggggtttcaccgtgtcgcccaggctatcttcaaactcttggactcaagggatctaccc

SEQ ID NO: 329011 - DNA, 398 bp, Homo sapiens
aagccccaccctctggggcaccccgggagcggaggcgggagcggggacgcgagcaacctctccccctgttggagagaaaagacccttaccactcgggtgagggaaagaagagacccctggaggggacgcctctctcctgcctagaggcgaggaagacccctgtactggccggggaggagacccccagaagtggaaagaagggagctttccgtagggaagcagagtgagaccaccctagcgcgcccccgcccctccaaacacacactctcaacagttcaggactttggaggcaaagagagacggggctgtgcctgtggagtaggcaccctcggcccaccactattcacaggagacaggagtccttacgttcagaagccactccagggaaagaagaggaa

SEQ ID NO: 329012 - DNA, 429 bp, Homo sapiens
gttagtgctttctttcatcttctctctgtcattgtctggcactagtgggtgtagggggttgagctggtggatcgtgggtttcactgccggggaagacagagtgatgactcagaaaatccaatgggaaatgtgatccaagggagctcctggatttgaacccacatcttgctgcagaagctctgagaaatgggtttcttagtgtttggggactaaagggatgggattcattttaggtcccttagggaagtggatgttttcatgctgaggaaaagggttatcggaaaacagctgcattttgagaacatgcatactgtgtagcagtgatttacacaacccaaccagtggtaagattcccataccacccttcacccttgggccttttcccctggagagtgggctgtcatgaaaatcacggtggcatctggggtc

SEQ ID NO: 329013 - DNA, 4846 bp, Homo sapiens
aagaggaatcggctttcagccttctggagaggggaagacctcgcccctcaacttcctcgtgcctagacagtggaacggggtggagcccctccgctcctatctccagcagacagaaagagccctccacctcagaaagatccagtttgggggggaggggaactcccccaagggggaagagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcacagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaagtgaactcttatgggcacccacaagctccccacctctaccctggcccatcaccaatgtacccaatccccacccaggactcagcaggatacaatcgcccagcacaccatatggtccctcggccatcagtgccacctcctggtgccaatgaggagatccctgatgacttcgactgggacttgatcacttagtgcatcacagagtgtggacatcagcccagggccgcgtggtgaaatctggcagtggggaaagagcaaccccagcccgtcccttccccccgtctgtatatagacatatatcctctttttgttctttctctgtcagagaagccactgcaagatgctgccgaagataaccctctctttcctgcctcattcttctctcttccttcctgttttttcctagttcttttattattattcttatattattattattattattggttatatactgtccatagtctcctgtccctacatcatggatcatgtccaccttttgctaatttaaaatcatcaggctggaagatgaagccatgatagctacagagaaaggttttagactccagtttacctttctcttggagaaactcaatgctaatcccaccttttggccctaaattgttttttgttcccatcagtttcaggccaggactggagaggccacattaccaagtagaaagggtctgaaacattacttggcagccaagaatttggaggttttaaaatggtgctaattctgtcctctgaggtcttccttgtccctttataccttcaatccttacttctgccagtctgtatttcctatcaagggtgaaagtgatgatggtggtgcaggagggtgacaataaaatcctagtggaattggagaccattggaagggatggaatataagtcagtgtgaaactgagtatacactgccatgttacatcagtgtccattggcttgttttgagcctgttctctaagaagataggattggttttagcccaaactctgcttctatggtagggcatgaggacaactattcagcatggttttagcttcttggagatgattccaacttaactattttggctttttaaacataattttctctgaaaattaattgtggctcttatttgcatttacgaatgatcttcccatccctttttcccattcagcaaatattagtttgtcctcctttaattgtttgcccaaatcttccacccatcttttttcttccctcattttctgggattctcaagaaagaaaaagtaacccattatcactctgagtttcgtcgtgccctgagacatgatgggaatctcattcccacctctcatagcagagccaaacctttagtgttggtggtaggaggatggggagaggaaaaaagagctggcaaagaaatggatagggaatattttagttctttaaatatataggcagatgcttctcttggaatccagatcatctggctgaagcttttgcaagtaggctttgaggggtgaaggagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaacctgactccctttgggcctcagtttcccctccccttcatgaaatgaaaagaatactactttttcttgttggtctagcattgctggacacaaagtgtagtcattattgttgtattgggtgatgtgtgcaaaactgcagaagctcactgcctataagaggaaataagagagaaagtggaggagagggacaaaaggagtaattatttggtatagatccacccatcccaacctttctctcctcagtccctgctcctcatgtttctggtttggtgagtcctttgtgccaccacccataatgctttgcattgctgcatcctgggaagggggtatatggtctcacaagttgttgtcattgtttttttgcatgctttcttaataaaaaaaaaaaagaatgtttacagttttatct

SEQ ID NO: 329014 - DNA, 1342 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329015 - DNA, 1883 bp, Homo sapiens
  misc_feature (1364)..(1364): n is a, c, g, or t
  misc_feature (1369)..(1369): n is a, c, g, or t
  misc_feature (1373)..(1373): n is a, c, g, or t
  misc_feature (1376)..(1376): n is a, c, g, or t
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaaaaaaaaaaaaacaacaacaaanaaaanaaanaanaacacaacaaaagaaaccaaaagaaaaacaaaaacaagaacacaacaacgaacaaaacacacaaacaaaaaaaaggagagagggggggcgcgcgcgcgcctcacagcagaaatgcattctccccccgcgggggggggagggcgccgcccaccgcctcctgagcgcgcgcgccgaccaacccgcagagccaataattgtgttgagaagacaacaaacaaagaagagcggggagccgggcggcacgccagccacgccaccacaaacacaaatgaaacgaaagaggaggccgagcgacggcaaggaccgacagcaacaatccataaaactaaatcaactaaaccaaaagacagccagaaagaaccagcacgaacgcacagaaacgaaccgaccgagggcggcagacaccacagacaccgcaacaagaaaagaggaggacagcacacaacgacactaccacaccacgaaaacaacaaccgacacaaaacacaacaacagcaccacaccaat

SEQ ID NO: 329016 - DNA, 1541 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaaaaaaaaaaggggggcggtttaaaaatcctgagggccaagtaaggtaccgtttttgtaaagggggcctagagggagaataaagcagaaggcgcgttaaggtcggcggaaggattggggttgggagactttggggggcaggggaacatagagataagaggattaataggtagtgaaagatggggaagtaggtaataaggaa

SEQ ID NO: 329017 - DNA, 1718 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaaaaaaaaaaaaaaaaaaaaaaaaggggggggggcaaaaaagattccctgggggggcccaggttttaggggtacccggttttttggtacaaagggggccccaaaaggggggccaaatataataaagcctaggcaggcccgctggtttaccaagcgttcgtgtgtcgtgggacaaactggcctagcctgggactcgtggggaagggacccttaactcctgtggtgtgggcacctaatgtggccaaactaccctaaggaaattaaagccccagggaaatataacattctaagggtttatgggtgtaaccatgctgaaataagctgcgctgaaagtaggtaacgggtagctatgaaatttaaggttgacacataaaacgct

SEQ ID NO: 329018 - DNA, 933 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccacaaggggtacatctgcagacatactgagtgtcaccgtcgacg

SEQ ID NO: 329019 - DNA, 1266 bp, Homo sapiens
cgtgggctggacagcgtggtgacgtcgcaacgcggcgcaggctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329020 - DNA, 1288 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatacttaccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329021 - DNA, 1136 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgctatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329022 - DNA, 783 bp, Homo sapiens
  misc_feature (23)..(23): n is a, c, g, or t
  misc_feature (29)..(29): n is a, c, g, or t
  misc_feature (61)..(61): n is a, c, g, or t
  misc_feature (85)..(85): n is a, c, g, or t
  misc_feature (107)..(107): n is a, c, g, or t
  misc_feature (121)..(121): n is a, c, g, or t
aggggacttcttctttaaatttnaacccncccggttaccaaggaacccaggaggtcccaanctggggtagtaaaaaatgcctttntggggggattttggcacggtanaatgcccgaggttntccagcccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329023 - DNA, 1829 bp, Homo sapiens
  misc_feature (1310)..(1310): n is a, c, g, or t
  misc_feature (1315)..(1315): n is a, c, g, or t
  misc_feature (1319)..(1319): n is a, c, g, or t
  misc_feature (1322)..(1322): n is a, c, g, or t
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatacttaccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaaaaaaaaaaaaacaacaacaaanaaaanaaanaanaacacaacaaaagaaaccaaaagaaaaacaaaaacaagaacacaacaacgaacaaaacacacaaacaaaaaaaaggagagagggggggcgcgcgcgcgcctcacagcagaaatgcattctccccccgcgggggggggagggcgccgcccaccgcctcctgagcgcgcgcgccgaccaacccgcagagccaataattgtgttgagaagacaacaaacaaagaagagcggggagccgggcggcacgccagccacgccaccacaaacacaaatgaaacgaaagaggaggccgagcgacggcaaggaccgacagcaacaatccataaaactaaatcaactaaaccaaaagacagccagaaagaaccagcacgaacgcacagaaacgaaccgaccgagggcggcagacaccacagacaccgcaacaagaaaagaggaggacagcacacaacgacactaccacaccacgaaaacaacaaccgacacaaaacacaacaacagcaccacaccaat

SEQ ID NO: 329024 - DNA, 930 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccaggtgagcctcgcggccccgggaagccggccccggcccgcctgcacctccggtgcttggcgggagcgctttcgagcctagccctcattggctggcgtgggccatccgcgccttctcattggcctgccacgcagtggggtggggcccagctgagcgcgcggttcggaaaagcccgcgctggctgctgcgcgaacctgctttttcgcgccaaagtcacaaagcgggtggtggcgggaaaatcaagggtttttccgcagtgccaggaacactgttccagggctctttgctcactaaatcctgttggccttgaatggacgctttagctgtggctttcttgtttctgagacggtctcggtgtgttgcccgggctggtctccaacttctgggctcaagcgatcctcccggctcagtcgcggttgactttaaatgctttataatgcccttgcgagaaatgtggcagcctgtcatcctacttagtggc

SEQ ID NO: 329025 - DNA, 467 bp, Homo sapiens
ttttgtaggtagtcatatgtgatacatactcctcagtaattaaccatcttcctgtctttcagttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329026 - DNA, 422 bp, Homo sapiens
gctcttgttccctggatggtgcatttaatagccatttatttttttgagtggagtttgttaagaaattacgcaagtcatattttaaagtaatcagaaaatattgattctgagttgtttaggtgttgccttttaagaaagtgagggtgccaaatcattaaatttctaacaattaacttttggaaaatttttgttcttaataggaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgtaagtagtttttaagtaaaaagaaaa

SEQ ID NO: 329027 - DNA, 1305 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaccaatccccctttttcctcccatcccggtcccccgtcataatgccggggttttcctt

SEQ ID NO: 329028 - DNA, 1380 bp, Homo sapiens
ctctagaggatgccttatgaatcgacggtttctcgtggccggagctggcgccctggttctggaggtaaccggttactgagggcgagaagcgccacccggaggctctagcctgacaaatgcttgctgacctgggccagagctcttcccttacgcaactcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329029 - DNA, 1282 bp, Homo sapiens
gctggtacccgcgtccaggtactattcccggagataatccggtccgcaccaccaacgctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329030 - DNA, 1287 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcttgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaa

SEQ ID NO: 329031 - DNA, 530 bp, Homo sapiens
cgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgctatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagatatagaagagtgactttcaaaagtgcactcttctatatctacaggggaggtgatagcatttgctttcgtgtaaacttatgtaatgcaaaattttt

SEQ ID NO: 329032 - DNA, 328 bp, Homo sapiens
gcacctagttctgtaactgggctgaacaagaggcaggacagatgggagaaacagctgggttctgccatctttacactctccaacacccagactcctaacccaggaaactgcctggagaggaggcagggaggaaagctgtttagtgcttcagtgctgtaaaacacctaggaataccaaacctttgaagaaaatctccagcagaaaatactgagacctaagcaaacgcaccgcagtgagtagggaaggggaagaagtaaacagagatcactgtaaagagatcaatgcaaaaacttaaaatactttaaagtggaaaaaaaaaatcctcaga

SEQ ID NO: 329033 - DNA, 590 bp, Homo sapiens
gtgaggctactgctggtccagggctgtattttgagaacttctactctactcatagggagttgcagacagagactgtgttatttcagccttcactgtgagtcagaatcacctgggtaacttttaagtacccttataacttccctacattccccaatcaattctatcaacggagaataaggctcctccaggcatcagtactttaaatgcctgaggatttcaatctgagccaaacttgagaaccattgttctaaataagagctctggtagttttaaaagccttgttttgacctttcactttttcaacagcggttactttctttctgagcatcctacaattccagggcccaaatgaaactaataaaaccaccaaactagttttgcagcttccaaatccttctaccgcaagcaagatacaagaacaattccatcatctcagaaaattcctttgtccctttgtagttaactcctctctctgcccccagcccttgagacaggaataatgcatgatgttcacaagggctaaaaaattccagagagcagttttccatgactagaggctaagggctaataagaccctgaaaaaccagggt

SEQ ID NO: 329034 - DNA, 329 bp, Homo sapiens
ggtatttctccagagcaacttgctgcccctgctccccatcactcctgccttatgacagctcagggctgtcacctcgagaaaggttaaggtcaccctcctggcaaccgtcagcccagcgctaacccacaccatctccacagcacctttcaaggtgccaggaggctcctgacttgagccatccttcgggaagcaattcatttgcaatcaagggtcacctcgatgtgagggtcgaatgctccagctgcacttaaagattgtcagcatccaacttagccccttcatcccgtcatacctccatctcactgccgtctaccgatgaggagagagaa

SEQ ID NO: 329035 - DNA, 637 bp, Homo sapiens
ggagttcacttattctgcttagtttgtggcgtgttttataagtatattaactattggtttgtttcctcaaatatttcagttggtttgttattttttatatgtggttcctgttgttttgatacacaggagtttaaaatttttacactgttaaactattaacctttgcttatatgttttagaatgatgccaatttagtaagactctataaatggaacttagagtctattttatagtttctttttaacctctaattcttatcttcttaaccagagctataactttcattatcaagtaaccatttatgctaaacctgaaaaaactgaatatgagtcttccccctaaaaaatctttacaaacacaggtgtcaacatgaatcatcgtatttcctgaccttgtggtcttccattacggtttcaaagcagagaagagtaactctgctattttttttttaagcaaattcatcttctaggtgctgcaaatatgataaactctgcttttttaaggagaatgcttgcctgagccgtagcagacatgccctgacttaacacatctaagtgaagctagagtatttttttcaggaatcatctttatgatgttcaagatgaattaaatggaggaaaagtaggttttaaaaata

SEQ ID NO: 329036 - DNA, 269 bp, Homo sapiens
agacagctccggccagccagtgcccccagagagcagacccagacagatgcagaaatgacgcagtggatgaggggcacagagacctgtcagggagcgggagctgggccaacgtctgggtacatgggatgcccttggctactgctgaggccgtgccccagccccaggtctacgcattaaacttcatcctccgcacagccccagtctcccacaggccccagcttatagagactgttgttgctccattttgcagaagaggaaactgaggcaga

SEQ ID NO: 329037 - DNA, 240 bp, Homo sapiens
ggattacaggtgtgagccaccacgcctggccatatggacattttttatgggagaagactcatggaacttcttcttagccttttttaacttctggagacagttttagtaattcacacattttcagaaaaccctattctagatttacacatatattggtataattagtattttccagttaacctaatatttagagttgtagtcatatttgaggggaggagctattttggtttcctttctgtg

SEQ ID NO: 329038 - DNA, 2160 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329039 - DNA, 378 bp, Homo sapiens
tccctcacctgccatcagcctcatctgaatctttgtctttcctcagataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329040 - DNA, 512 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggaggtgagtacctctgcagcccccgggcagtgtccaactaaacccaagtgttcccatgtgcccaccgccctgccagaacatggacacttcacacaagtccctgccccagaagccaacagcctgtcccaaccatgtcgcatggactcagatccaacaagcctgccagagcatctgctcagtgtcagggacggggaggggtggtcagattgaacagagcaggcctggctggaggttgagcgggtgagtgtcctgtccccagacaggaagaagtagc

SEQ ID NO: 329041 - DNA, 2552 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329042 - DNA, 3047 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggtatgctctgagcttaatagggactgcgtggtcctggggagggagggacaggactgtagtcctttggatctctggctctctacatcttaagagagccaagagggtctcttttagccgagaaaaacatgtacaaggacatccctctcctaccttgggtgaaaaacagtgttctaccctcctaggctcccattgcttcttctcatgatactacccacacatgcttctgatttcccatactcaagtataaagtgcttagggcagaactcagatgtagaaaattccactcccggaaatgtcttcagaaatcaatgacatttcagacccctcctgcctgcagaaagccccacctaacactgacctgccagcaaactctaaagaaacccaaaagtcaccatcagactgcaggccggagatacctgaggggaatctcagggctgggacataggcttaatttctgaggccccattctccagccatcctgactctgtttcttaggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329043 - DNA, 1637 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactggaaacagcacagaccagtgatgacgatgtcgagcgcgaccgctgacgtgaccgctgcaaccagaagggatccgctagagcac

SEQ ID NO: 329044 - DNA, 826 bp, Homo sapiens
gcagccaagggtggatggtccagggatggagctgccaaggtgggtggcctagagagggagaaggagggtaggaaagagctggagggagaaagccttgtgtggggagggaaggctggctggaaagaggctcaggggactgaggtggtgactcttggcaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329045 - DNA, 2250 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329046 - DNA, 229 bp, Homo sapiens
tctagtggaccttctacgctcagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaacgcgctgctggtctgagcgtgactggggatacctctagagt

SEQ ID NO: 329047 - DNA, 2651 bp, Homo sapiens
cggaggcgttgaatgcccggaggcgttgaatggcccggaggcgttgaatggcccggaggcgttgaatggcccggaggcgttgaatggcccggaggcgttgaatggcccccctcctgcagcccctcagactcagacttggaggccctatccctggccccagtgcttcgacaccgtccctcacattggccctggaaagttgctttatctgaagcctggaacctcctacctcaagggggccgaggacacgtcttcttcctcttctgcttttctctacccagcacgcctgtggtccacctctctgagctttctcccagtcctaggactccccctctccctgcagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329048 - DNA, 1188 bp, Homo sapiens
tctagtggaccttctacgctcagccaagcacccttaggataccaggaccctgtttcccttcggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329049 - DNA, 1141 bp, Homo sapiens
tctagtggaccttctacgctcagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaact

SEQ ID NO: 329050 - DNA, 713 bp, Homo sapiens
  misc_feature (96)..(96): n is a, c, g, or t
aacagggccaggaggtgtgggagcgggagacactagagtaacctatgtgcacagcctctccatataccatgtgctgttgcgcctgctcgtgcgcgnacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatggtttcatctgtatggaaaaggagctctggtaactttggccaagacttttcagtaggaaatgcttcaaaatacaaagcaagagctattttcaagaaagaccttctaaatttatattaggacatagtgagaagaaagccatctgaaaaccaggaagagagccctcaccagaatctgaccatgctggtgccctgatcttggactttcagcctccagaactgcaaaattctggtgtggtgtgaatgctgtggctcagtccgaacatgtttttttctgtaattttatcattattacacgattgcaatatcagttttgttttttaattggaaagcaacattttctactgttgaaagacgttttttgacaaattgacccttcctagtattgagtactaagttgaggactgcatctacttgttttttacattatagagaataaaatactattgatttgaaaaatacatatcacttg

SEQ ID NO: 329051 - DNA, 531 bp, Homo sapiens
ggagcgttgcgggcggcggggtagacccgggcagtttggccccagtcctcacccctctgagggccgaagtccgccctgcgctgcgtgggaggctggcgcggagggcgccgcggcccagttgtgtcacttttcccgtccgcccccctgttgactagtcctcccagcggggcagcgagttgccgtgctgtgccagacgtagagggccccagtgtgtgatgttccctttcctgagtaacaccattttctatctaaatgaagaaatggaggcatggaagtttcatctgtatggaaaaggagctctggtaactttggccaagacttttcagtaggaaatgcttcaaaatacaaagcaagagctattttcaagaaagaccttctaaatttatattaggattaagcgtctgtaacgttgccactcgtcgctgaggctcctggtttcagcatgtctccttggttcccagccagctctgggtgttcaggtagcagctgtggctgggagtgtctctccagtccacattccttggccatgaa

SEQ ID NO: 329052 - DNA, 4249 bp, Homo sapiens
aacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggaatcctgtctgctgctgtcttcctggtttaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaagtcttgctctgctcacttctatgtttgcagtcaaattattccttatgttggtgacctaaagagaattactttcattcatttcatttcccccgtagcagatggaagtgagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgatataacctaattttaaactatccaaccttctctaattcaaagttcttcaatcctaatcactctcctttttacccccttttacctcttacccttatcatcac

SEQ ID NO: 329053 - DNA, 4226 bp, Homo sapiens
aacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggaatcctgtctgctgctgtcttcctggtttaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttggtgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaagtcttgctctgctcacttctatgtttgcagtcaaattattccttatgttggtgacctaaagagaattactttcattcatttcatttcccccgtagcagatggaagtgagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgaaaaaaaaaaaaaattaaaaaaaaaaaaaaaaaaaaaaaaaaaaaaatagttggtgcgcgcgccctcgggccctagaaaaaactttcataaacaattcgttggggggccgcggggcccacatgtgtgctaggggaacaagtggccatagggggttcacaagaggaacaccggggcacaacgaacaaaggggggggattctccccatataaacacgccgcag

SEQ ID NO: 329054 - DNA, 4150 bp, Homo sapiens
aacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggaatcctgtctgctgctgtcttcctggtttaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaagtcttgctctgctcacttctatgtttgcagtcaaattattccttatgttggtgacctaaagagaattactttcattcatttcatttcccccgtagcagatggaagtgagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatgattagtgtatttctccggggggggggtg

SEQ ID NO: 329055 - DNA, 342 bp, Homo sapiens
taagcatgcactatgtatttcatcctcatttattgggtctgggatggaagtttctagccagcatgaacctaacctactttttgagacaaaattcactgtttcgttacaggcaaaattctggtgtggtgtgaatgctgtggctcagtccgaacatgtttttttctgtaattttatcattattacacgattgcaatatcagttttgttttttaattggaaagcaacattttctactgttgaaagacgttttttgacaaattgacccttcctagtattgagtactaagttgaggactgcatctacttgttttttacattatagagaataaaatactattgatttg

SEQ ID NO: 329056 - DNA, 270 bp, Homo sapiens
tgagatagaccaagtgaccttgtgtgttctcttcctcctctgtgcttgtttcatctgcagaaccatctgatggatggcagacagctgaaccaggtactgccccttcccaaacacaaatgccctccccattcaccattccctagagcgttcacttccttcatctatgaaaggcaattactagggtctagcaagactgccaatttggtaatgcaaagcaggagataagtgtgaaactctagactggttttctgtttcaaagggcagcaggat

SEQ ID NO: 329057 - DNA, 4368 bp, Homo sapiens
aacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggaatcctgtctgctgctgtcttcctggtttaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaagtcttgctctgctcacttctatgtttgcagtcaaattattccttatgttggtgacctaaagagaattactttcattcatttcatttcccccgtagcagatggaagtgagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgaaaaaaaaaaaaaattaaaaaaaaaaaaaaaaaaaaaaaaaaaaaaatagttggtgcgcgcgccctcgggccctagaaaaaactttcataaacaattcgttggggggccgcggggcccacatgtgtgctaggggaacaagtggccatagggggttcacaagaggaacaccggggcacaacgaacaaaggggggggattctccccatataaacacgccgcag

SEQ ID NO: 329058 - DNA, 3989 bp, Homo sapiens
  misc_feature (96)..(96): n is a, c, g, or t
aacagggccaggaggtgtgggagcgggagacactagagtaacctatgtgcacagcctctccatataccatgtgctgttgcgcctgctcgtgcgcgnacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatgggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaagtcttgctctgctcacttctatgtttgcagtcaaattattccttatgttggtgacctaaagagaattactttcattcatttcatttcccccgtagcagatggaagtgagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgaaaaaaaaaaaaaattaaaaaaaaaaaaaaaaaaaaaaaaaaaaaaatagttggtgcgcgcgccctcgggccctagaaaaaactttcataaacaattcgttggggggccgcggggcccacatgtgtgctaggggaacaagtggccatagggggttcacaagaggaacaccggggcacaacgaacaaaggggggggattctccccatataaacacgccgcag

SEQ ID NO: 329059 - DNA, 746 bp, Homo sapiens
  misc_feature (96)..(96): n is a, c, g, or t
aacagggccaggaggtgtgggagcgggagacactagagtaacctatgtgcacagcctctccatataccatgtgctgttgcgcctgctcgtgcgcgnacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatggtttcatctgtatggaaaaggagctctggtaactttggccaagacttttcagtaggaaatgcttcaaaatacaaagcaagagctattttcaagaaagaccttctaaatttatattagaaccatctgatggatggcagacagctgaaccaggacatagtgagaagaaagccatctgaaaaccaggaagagagccctcaccagaatctgaccatgctggtgccctgatcttggactttcagcctccagaactgcaaaattctggtgtggtgtgaatgctgtggctcagtccgaacatgtttttttctgtaattttatcattattacacgattgcaatatcagttttgttttttaattggaaagcaacattttctactgttgaaagacgttttttgacaaattgacccttcctagtattgagtactaagttgaggactgcatctacttgttttttacattatagagaataaaatactattgatttgaaaaatacatatcacttg

SEQ ID NO: 329060 - DNA, 440 bp, Homo sapiens
agatgttaatctctaatctttgcagcatctgttatttttattcaggggtacaagtgctttgtgtgtgctgcggtgagccctggccttctggaagctctgtgcttctgaggggctgagggggatttgggggtcccttttcatagtgtgggctgtctttcccaagatgcagtgatgacccatcagaggcagggttggtattgtccgtggggtccagtccctctatcttccagggcttttctggtcacaagagaccatggccagaagtgggtatcgtgcttgtgtctggggcctggggagggaaggaaaacaaataccaccccctgcagaagagatcgttaatggattctttgagtaaccagccagatagcttgtttgtgtgcgaggttgggacattttccgtaaagagcagactaaatataggctcgagggtggggaccagg

SEQ ID NO: 329061 - DNA, 884 bp, Homo sapiens
  misc_feature (839)..(839): n is a, c, g, or t
  misc_feature (860)..(860): n is a, c, g, or t
  misc_feature (879)..(879): n is a, c, g, or t
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaacacaacggggaaacccaaaaaaaaaaaaaaaaaaaaaattgtggggggggggccgaaaagttttaacaattgttggggggggcccaggattgaatggganaggtgccagaaaacggggaanggggggttccccaaaaacncgggg

SEQ ID NO: 329062 - DNA, 865 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaactcggcccaatcaactttgacttggagcaactttttcatgccggccgaatttaggctcacttgccaatcgccctatatgaggggatttttaatgggccgcgtttacgggggctgggcccctgcggg

SEQ ID NO: 329063 - DNA, 797 bp, Homo sapiens
  misc_feature (752)..(752): n is a, c, g, or t
  misc_feature (773)..(773): n is a, c, g, or t
  misc_feature (792)..(792): n is a, c, g, or t
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtgcacaacggggaaacccaaaaaaaaaaaaaaaaaaaaaattgtggggggggggccgaaaagttttaacaattgttggggggggcccaggattgaatggganaggtgccagaaaacggggaanggggggttccccaaaaacncgggg

SEQ ID NO: 329064 - DNA, 656 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagcacaacggggaaacccaaaaaaaaaaaaaaaaaaaaaaaaatttgtgtgggcgggccttgggcccccggaaaaagtttttaaaacccttcgcgttgggggcgccggggcccccaagggtagggaacacggggccaaaaggggttcccaaggagaaaaccggggcagggacccggggcggggtttccccccaaaaaaaaagc

SEQ ID NO: 329065 - DNA, 2696 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaagtgagtgtggttaggttaatatgagatttttttacacaaaaatcattgtgtgcaattactgttctagctaagcaccttaatgcttctaagtgcttttcatttcgttgaggcaagacaagtggggctttcatcttttttttctctatgtcatttatattctagttatttctgaagagtgtactaggttgagaagtttctaatgtgaaaaatcttgttca

SEQ ID NO: 329066 - DNA, 2629 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaagtgagtgtggttaggttaatatgagatttttttacacaaaaatcattgtgtgcaattactgttctagctaagcaccttaatgcttctaagtgcttttcatttcgttgaggcaagacaagtggggctttcatcttttttttctctatgtcatttatattctagttatttctgaagagtgtactaggttgagaagtttctaatgtgaaaaatcttgttca

SEQ ID NO: 329067 - DNA, 2181 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtgatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaagtgagtgtggttaggttaatatgagatttttttacacaaaaatcattgtgtgcaattactgttctagctaagcaccttaatgcttctaagtgcttttcatttcgttgaggcaagacaagtggggctttcatcttttttttctctatgtcatttatattctagttatttctgaagagtgtactaggttgagaagtttctaatgtgaaaaatcttgttca

SEQ ID NO: 329068 - DNA, 2880 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaaggttggttacatcacttgctgagttgtatgacggccacctaggaggcagttcaaacaaggacagcaaaagaatacagactaagaagaaagagaggaaagtcttaccagttaacatcaggagctgaactgaaattgaaatgaaatgcaactggacatgtttagactcattttctttcatttacaggttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaagtgagtgtggttaggttaatatgagatttttttacacaaaaatcattgtgtgcaattactgttctagctaagcaccttaatgcttctaagtgcttttcatttcgttgaggcaagacaagtggggctttcatcttttttttctctatgtcatttatattctagttatttctgaagagtgtactaggttgagaagtttctaatgtgaaaaatcttgttca

SEQ ID NO: 329069 - DNA, 604 bp, Homo sapiens
aaacactgaagatctgactcaggaagtgctgggaaggagtccagtgtgtttatcctgacccctgttcaacttcttcctgcagcccactccatgctgggaatagacaactctcctctgaggctgaggctaaccagattatgcagaactttcttctctccaacattgcctggagctggggtagttgttaagtccttgggtttctaaagacttgaaaagctgcttgaaaagaataactagatggcttgttagtcagtttttttattattagaaagcagaataatgccattaaatttaaaataaattttatagaaaattaaaatatatttagaatttattaaatgagaatataactatacttatataatcatgttttctacaaaatatgaagttagtacattctgatttttattttaatgagaaaacactttgaaattttaaacaaaggacttttgaatgaagaatgactttgaaacctggaatcctgctacatatattcctttgaaaattaacattaagggtggttttgttttgtttatctgtttctttgggtatcatttctcttacagctttctgtgatagttgcaattgagttttggtaaattaa

SEQ ID NO: 329070 - DNA, 2791 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagcccactccatgctgggaatagacaactctcctctgaggctgaggctaaccagattatgcagaactttcttctctccaacattgcctggagctgggttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaagtgagtgtggttaggttaatatgagatttttttacacaaaaatcattgtgtgcaattactgttctagctaagcaccttaatgcttctaagtgcttttcatttcgttgaggcaagacaagtggggctttcatcttttttttctctatgtcatttatattctagttatttctgaagagtgtactaggttgagaagtttctaatgtgaaaaatcttgttca

SEQ ID NO: 329071 - DNA, 1065 bp, Homo sapiens
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaacaaaaacaaaatttacaaaaaacacaaccaaaaaaaaaatttgtggggggcggcggcgaggaaaaaaggtttctacaacccatgtctggtgggcgcgcgccgccagggaggaatagcagcacactggcataacggcgtgccaaaagaaaacccgggagagcagaggcggggcggtttcacccaaaaaaaaaccgccgggggcacggggttttgaccaactcccaggaggggccgggggcatgactgggtccacaccagggggcccaggaagccataaacccccccgcagcgcggggaaaaaaagcaaggagcacagtgaggaagga

SEQ ID NO: 329072 - DNA, 907 bp, Homo sapiens
  misc_feature (756)..(756): n is a, c, g, or t
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaattttgggggggggcngggaaaagtttttaaccattggtggggggggcccgaggtaggaacagggccaagccggtccaaagaaccggaggaggtggggtttcccaaaaaagccggggcggggtttgaaatcagggttggggttggttaagggcggctaacgcgcggg

SEQ ID NO: 329073 - DNA, 909 bp, Homo sapiens
  misc_feature (826)..(826): n is a, c, g, or t
  misc_feature (853)..(853): n is a, c, g, or t
cggagtccagacttccttatggcccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaggggaaaaccacctcatggcggggggtaatggggctgggaagggccctttttaaaatactggctttgaagtggccttataaaattgnggtttggggccattaatttctccattntttggcggtttggggttcaaaaaaaactttttgggggagagagggggcattttaag

SEQ ID NO: 329074 - DNA, 3350 bp, Homo sapiens
  misc_feature (806)..(806): n is a, c, g, or t
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagaggaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtanggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtatacatgcataaaaactatccattcaaacccaaaaatttaa

SEQ ID NO: 329075 - DNA, 2156 bp, Homo sapiens
cagtctatggatctctgcagaattcggcttactcttcatgcctaccacgtcggagaaggcttctatcatgtttgcacgacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattat

SEQ ID NO: 329076 - DNA, 1859 bp, Homo sapiens
ccttaaaaccgggtgggaaggttggcccagggataccaattaagtttaaaaaaaaaaaaaggccaggcgtggtggctcatgcctttaatcccagcactctgggaggccgagcaaagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtatacatgcataaaaactatccattcaaacccaaaaatttaa

SEQ ID NO: 329077 - DNA, 1585 bp, Homo sapiens
  misc_feature (806)..(806): n is a, c, g, or t
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagaggaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtanggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgataaggaagaaatatccaaagttaggtcactcggcgtgagcagggtacc

SEQ ID NO: 329078 - DNA, 3151 bp, Homo sapiens
  misc_feature (806)..(806): n is a, c, g, or t
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagaggaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtanggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattat

SEQ ID NO: 329079 - DNA, 1891 bp, Homo sapiens
  misc_feature (26)..(26): n is a, c, g, or t
  misc_feature (43)..(43): n is a, c, g, or t
  misc_feature (49)..(49): n is a, c, g, or t
  misc_feature (59)..(60): n is a, c, g, or t
  misc_feature (72)..(72): n is a, c, g, or t
acgacggcagtgctcgttatttggtnatagcgtctccagaggntccctngtgagggatnngatcggcattanttgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtatacatgcataaaaactatccattcaaacccaaaaatttaa

SEQ ID NO: 329080 - DNA, 2107 bp, Homo sapiens
cagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggaacgtcctggagggcttccgggtgacgctcacctcggtcatcgacccctcacgcatcacaccttacctgcggcagtgcaaggtcctgaaccctgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgc

SEQ ID NO: 329081 - DNA, 3005 bp, Homo sapiens
cagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggaacgtcctggagggcttccgggtgacgctcacctcggtcatcgacccctcacgcatcacaccttacctgcggcagtgcaaggtcctgaaccctgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcattcccgctcggacactcgcgcgcagccccgcggccgtccctcctcgctgcggcccgcggtgtcctcggggtgcgagctgcacgtggacgcagggccccctcaggccgccagggggcggcatagcgcagcgcgcccccgacccggaagacggaagcccaagaacgccgcttccgcccggcgcccacttccaagatggcggcggggcggggccggggcggggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtctgcgggactaggtcctccaagcgcatctccaagctggcctatcaccaaggcgtggtcattgtgacctgccccggctgccagaaccaccatatcatcgctgacaacctgggctggttctcggacctgaatgggaagagaaatatcgaagagatcctgacggccagaggcgagcaggtgcaccgtgtggcgggcgagggggccctggaactggttctggaggctgcaggggcccccacatccactgcagctccggaagcgggtgaggatgagggtccccccagccctggcaagacggagccgagctgactcctgcgctccccggcactgtgggacttcggccttccagaaggaggttttggccctgggcctctctggacgtggcctgttttctatcaataaacagacattacttcc

SEQ ID NO: 329082 - DNA, 675 bp, Homo sapiens
ggcacacgagcagttcagggtcccagcaggaagtggggctgcagggccggggtgggtcctgggcctggccatcaggcagcctagcaggttgttctgggcatggagggggcctggtgtggctgagggcatgcccagggctccctggaggatcccgctctgtgccctgcccaccctgtgcctggggagccctctgccctcacagcccacccaccccattttctatgaccacagagctccgacctggaagatggctcacccaggaggtcccaggaggtgagtgagaccccagccagcacgaggctggccttccttcacctggggtcctggctgagctgccaccaggcatagccccacactgcccgtcacatggccctgctcggtgggctgggctgggtggaggaagagcaggtggccaaatgctaaggcctctgatggctcaaggggtaaggtaaggcacggacagtgcccacctcctggccgcccaatgtccgtctgctgggcacctgagtctctgagaagctctgtgcagggggtgacggcaatggctgcacccagctgagggccaagggctggggtgggcagtgtggccgggtccagtccttggcgaagtggcctaatgggacatcttgactctctttggaagctctcactcccccaggacctggaggacaccca

SEQ ID NO: 329083 - DNA, 381 bp, Homo sapiens
ggccggggcggggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtaggcgcgcggcgggacggaaccggggacagacccgtatctgacgctacacggcctgcggggagaagcggcccgccggggatccgggaggcggcgtggtcaagtcac

SEQ ID NO: 329084 - DNA, 2180 bp, Homo sapiens
cagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggaacgtcctggagggcttccgggtgacgctcacctcggtcatcgacccctcacgcatcacaccttacctgcggcagtgcaaggtcctgaaccctgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccagagcacacaaatggaggggctgtgaccagcctccgcgcccagcggcttgacgtcctccggagcctctgcttggagttgggcggccgggccgagggcccagggcaagcttggggccctcactgagggtcggccttgtgctgtcccgtcaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcaacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgc

SEQ ID NO: 329085 - DNA, 1791 bp, Homo sapiens
cagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggaacgtcctggagggcttccgggtgacgctcacctcggtcatcgacccctcacgcatcacaccttacctgcggcagtgcaaggtcctgaaccctgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgc

SEQ ID NO: 329086 - DNA, 1623 bp, Homo sapiens
ccctcacagcccacccaccccattttctatgaccacagagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcattcccgctcggacactcgcgcgcagccccgcggccgtccctcctcgctgcggcccgcggtgtcctcggggtgcgagctgcacgtggacgcagggccccctcaggccgccagggggcggcatagcgcagcgcgcccccgacccggaagacggaagcccaagaacgccgcttccgcccggcgcccacttccaagatggcggcggggcggggccggggcggggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtctgcgggactaggtcctccaagcgcatctccaagctggcctatcaccaaggcgtggtcattgtgacctgccccggctgccagaaccaccatatcatcgctgacaacctgggctggttctcggacctgaatgggaagagaaatatcgaagagatcctgacggccagaggcgagcaggtgcaccgtgtggcgggcgagggggccctggaactggttctggaggctgcaggggcccccacatccactgcagctccggaagcgggtgaggatgagggtccccccagccctggcaagacggagccgagctgactcctgcgctccccggcactgtgggacttcggccttccagaaggaggttttggccctgggcctctctggacgtggcctgttttctatcaataaacagacattacttcc

SEQ ID NO: 329087 - DNA, 681 bp, Homo sapiens
ctcagccttccaagtagctgggactacaggcgcccgccaccacgcccagctaagttttttgtatttttagtagagacggggtttcactgtgttagccaggatggtctggatctcctgacctcgtgatccacccacctcgacctcccaaagtgctgggattacaggcgtgagccaccgcacccggcctatttacttatttcttattacgatttacaaaatgtgctctcatgtttgaaaaactcatatttgaatatatgtgaggtaaaaacatttaaatgctggctgctaaattcacatcttaaaaacctatggaaatttctggaaggaaactttcctgtagttagcatgatggtttatgtgacccagaaagattgcagcttctcaggaacagacatgtctgcccctttctgcatgtgcaaatgcaagagagtttccatttactgtgattccgacaaaattagaggtaatagcaaataatcacattctgttgaaactgcatgttatattatctgtattccctccaggttttaagatcagtgaggtcagaaatcatgtatattttgctaattaatctcttacttcaagtacaatgcctggcacatagtaggcacttaatacgtatgcactaaaccatacaaaacaaatgaaagaatgaatctagatcacttttagttataatat

SEQ ID NO: 329088 - DNA, 446 bp, Homo sapiens
tcattttggtgccattgaggaaagaagagcttcagatacaaatataactgacagtgaatcaagacaacactggaatagctttgggggagacatacataaaaatatctttctgtaggccactaaacataggatatattagccctcagattagaagaccttctaaattcttttacagtcctatattctaggagtctgcttgtgtgctataacatgattttcttacagaagccagtatttttaaatgaaaaaaaagtgtgaggtttccactgggcctttaacagagatgctgaaatgaacaaaacccctgaaatatctcagggataattgggggcaaagggattgggtggccacaggaggacctgatccctctgcctagaatatacagcaccctcatcacctcttatccttcttggggtcctctggtgggctcctcaccattgtccatg

SEQ ID NO: 329089 - DNA, 298 bp, Homo sapiens
ccaactgataaaaaggaaacccacagtgaattttacagttgaaagatgtctcttatgcatcaaaccaaacttaacaaaagttttataaaattaccatattcacttatgttttccacttaatatttttgacacagtctcactctgttgcctagcctggaatgcagtcgtgtaatcatagctcactgcagtctccatctcccaggctcaagtgatcctcctgcttcagcctctgagtagctgggagtacaggagcacatcactatgcccagatgatttttttaaattttatttttcgtac

SEQ ID NO: 329090 - DNA, 307 bp, Homo sapiens
tgacagctgactctagaggatacacggcgagctgccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagctcgcccctgagttagcagctcgcccctgagttagcagctcgctcctgagttagcagctcgctcctgagtt

SEQ ID NO: 329091 - DNA, 573 bp, Homo sapiens
cctactattttttaaccaaatcaacaacagctaaataggttgttggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329092 - DNA, 8700 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329093 - DNA, 8667 bp, Homo sapiens
  misc_feature (2481)..(2481): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329094 - DNA, 9241 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgtaactacgcgttctctgctgctgcttgtcacctttgcacctgggggcaccaggcctggagaggggatggggaaccccacagcccttctgtcctggcggggtggctgggggatccagggcatggcgctggggggatccagggcgtgggtgagggtgagatcccaaagccccgagcaccggcaccatcaccgccccctaatccatgggaggagcctgtgatgcgagccgatggcatcttcacgggcaatgaggccttcctggtggcccaggtttctcagtgtcatgggctggtctcatcagccatctgccaactaccagcttgggaccgctgaccacagccccactcccatgcacactgggacacggaggcccagagggtggcgggcaggtccacagtcacccaggaagctggccccacccaggattctgccccgagctccgtctagcccctccccacccccagaaggttctgtcaggagagtgctgcctgactctgggcccccccacttgcctgcaggaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329095 - DNA, 8586 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329096 - DNA, 8505 bp, Homo sapiens
  misc_feature (2319)..(2319): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329097 - DNA, 8670 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacagccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329098 - DNA, 8838 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggtaagaccaccctgacagcggccaccttcatagacgcgattatcatgcgtcaaattgctcacgataaaggggcgcgagaaggaggtgcgctggccaacggctcccctcgcgatggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329099 - DNA, 7374 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329100 - DNA, 8670 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329101 - DNA, 3754 bp, Homo sapiens
tttgttagtttgtctgtttgcacttaaagttctaagcactttggaaagtttctaagcaacttctcacttccaagcaacaacttaaccaacactaacaacttactattattaattagtattttcttggctcatccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329102 - DNA, 7507 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagt

SEQ ID NO: 329103 - DNA, 2453 bp, Homo sapiens
aggcacatgaatctagtatgtgcagctgatcaagaactggagacaatgggagccagcgaagccacgctgctgaacatgctcaacatctcccccttctcctttgggctggtcatccagcaggtgttcgacaatggcagctcgcccctgagttaactcaggggcgagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329104 - DNA, 5097 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctcgtgagtggcatgacggatatcgacctgactcacggcacagctatcgaccactgattacgcgacttcatctcgca

SEQ ID NO: 329105 - DNA, 4425 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaatggaggcaaaggggatcctcagatcga

SEQ ID NO: 329106 - DNA, 2506 bp, Homo sapiens
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccaggtacgaatgtggccggctggcctggggggtagggccgggccggggcgggcatcccaaggtccccggtcctccacaaggaaccagttgtgttggtactcttaaacctaataagatcggtagattcattaacac

SEQ ID NO: 329107 - DNA, 1475 bp, Homo sapiens
  misc_feature (1433)..(1433): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggggggatcctctangagtctgaaacctgcagtgcattgcaatgccttgtgcacttg

SEQ ID NO: 329108 - DNA, 1095 bp, Homo sapiens
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgcatcatgttttcgaggttcatccgtgtcgagcgtgggtcggtccttcgttcctttttgtggctgaatcatatttcactgtaggggtaggtcacgtgttgtttacccactcatcagtcggtggacgtgagattgtttgcatatttggggtattgtgaataaagttgctgtgaacatta

SEQ ID NO: 329109 - DNA, 305 bp, Homo sapiens
ggcttgtgtggaggttggccccgaccaacggcacgtgggactgcccagcacagctccagcccagcataaaggctcagggagtcaggtgccacggtgggtactggctggggaggggcgtctgaaatgtggccttcccacggggttcagagccgtgcggtgacaccgtcaaggcctggtctactccctccctggctcaaaggagagaaaagggcagaaggcaaagtgcctcctctcccggctcctgccaataacctggcatcttcttttcagcctccatggagctgaatgagagttctcgctggaca

SEQ ID NO: 329110 - DNA, 284 bp, Homo sapiens
gcattgaatgtcagcttgtgagggctgggatttctgtttcgttcactggggtgaccccagttctcacaacaatgcttgccacgtagtagaggctgcatcaatattttttaattgattgagtgagtgaatggatgaaagaatgaattttttaaaaactataacacaaaagcaaatgagtcagtgagcaaaaagtgaactaaggcaatgaagaaatgaaggagtgaatgaagagacctggtccttgggatcccgaggtccctatcctcaaacaactccccgtaaat

SEQ ID NO: 329111 - DNA, 473 bp, Homo sapiens
actccagggaccatcagagagcccaccactcgcggcagggagagttgactgttgaactttttacccctttctgcagtccccccagggagcgtggggaccagggtcaggcccagggtgcgcagggcagtaagtaacaagtgtgccatctcagggttagcaaagccctctgtctccctgcctctggaggcatcagatgtcacttccatcttatagatgacaaactttttgaggctcagaagggggatgcagctggtctgggctatggctgtggccagggctagagcttacatcccctctgccccagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaaga

SEQ ID NO: 329112 - DNA, 8673 bp, Homo sapiens
  misc_feature (2487)..(2487): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329113 - DNA, 5972 bp, Homo sapiens
gtgttcctgtaatggtaatgatccgatcttcggatccttctaaaggctcatcaattttgatcgaagctcccgactcatgacggatttgtttaatccgctgaccacctttgccaataatagatccagccaaatctttgggaatagttacttgtgtagtaataataggtccaccaagatcaccatatgagccacgaccccctgcataggaataatcatatccggagccaccctgtggttcataagccatctgccattctgatgggctccatgtatctattgcagagtcccaagtttcatcagcactgaaaccaaccatgccgtcgtaacggtctccaggtctccctcttctgtcataggccatgaggtctccccctctaggtggtggtggtggaggaagaggaagattccgagctctgctaccaccccggccgcctcgtccgggaggagggggaggtggtcctcgacgagggctcatatcatcataatctcttctagatggaggcatgggacgcccaccccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329114 - DNA, 2842 bp, Homo sapiens
ctaggtagaggcctggttgaaatcggcagaggctgcaggcgggtgtcatggcttgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329115 - DNA, 8248 bp, Homo sapiens
  misc_feature (2062)..(2062): n is a, c, g, or t
tgttcctagagtatcacacaggcaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329116 - DNA, 8085 bp, Homo sapiens
  misc_feature (1899)..(1899): n is a, c, g, or t
cgcgtcttatgttcatataagcgggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329117 - DNA, 7883 bp, Homo sapiens
  misc_feature (1697)..(1697): n is a, c, g, or t
aacaaagaacaaacaaccaaacaaaaacccaggaaaacagagagggaccaggtataaaggtgaagcgagtgaaaggcccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329118 - DNA, 8499 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329119 - DNA, 7550 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 329120 - DNA, 7939 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcagggcggctgccgactccctcccttccttgggcagaatgaattcgatgcgtattctgtggccgccatctgcgcagggtggtggtattctgtcatttacacacgtcgttctaattaaaaagcgaattatactcca

SEQ ID NO: 329121 - DNA, 7819 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacagttttagtccacaagaagaaattttccaggctccagtctttgccactcaacctgtgtcagacttcacctttataaatggagatcgttaagcctggagccagctccatcaggtcacggactcgtggccttgggtagaaggcccagtcgcgctgctgtgatttcagcactcacccttgttggaaatgttgctttttcttcatgcacatggctgttttttcaaaagtgctgcagaaatgtggccaagacagcagaaaaggtgtgagcatccctggctacaaacgtatttgaaaccaaaagggaaaagaaaacgcaggcagccagcagttgctacagaaacgtgattttcaaagcatctgcatcacccgcaacctcatggaagcctcggtttggtttacaaaggagcgagtggtcggaaagacgatttgaccactttgtattcgtatgattcattcggagcagaagtttaaaactccatgaaacacttgccccgtggtgggcacggtggaatggggcttcactgggggcttttgaaagcaaaggctggtttaacaaaagttctgaaaagacagcacctctggggggtgtgcaaaggcccccacctccacgtggttcacaagaaagaaaaaagggaaaggaaatgtggttaacagaaaaggaggtttccccgattgt

SEQ ID NO: 329122 - DNA, 5924 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccaccatcaacctcctacccgtccccgccgcggatcctctaacag

SEQ ID NO: 329123 - DNA, 4922 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggaggtccacctcctgggttcacgccattctc

SEQ ID NO: 329124 - DNA, 4248 bp, Homo sapiens
  misc_feature (2538)..(2538): n is a, c, g, or t
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccgggcccccantgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcctcatgtgtaggagcctcatgtgta

SEQ ID NO: 329125 - DNA, 1523 bp, Homo sapiens
gagtctttgaggacacagcctcgctggaggcagtttctggtgccagtgacggggtggcccgtgagctgatgacgaggactggcttttaatccttggtggtgattaagagaaagcttattgcggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggaggtgagtccaggccctgactctggcctcagctccttttccctggcatcccccgtgagggtgcagaggccctagccagaaaccacctcccgggtggtttacgtcgaggggctttgccaccgaagcgcgggtggaatcaaggtgggtattgaggtacccgtcccaggcctgcaggggcgagcagagagaggggtgttaatgtgtctgagagggagggtagc

SEQ ID NO: 329126 - DNA, 430 bp, Homo sapiens
cgggtgaagcttgcttccaaatgtctaaggcatctcaggtggtgagttccccatcatcaaaggcatgcaagctcggcaccaagtgagctgatgtgaggtgtttgatcctcacagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacagtaaggggcctgcaggctcccggggaagcatggggccacaggtgggcgggtggcctgcctgggcagctggagccgcccagtggcagaaacccacggtgcaccttcgaaagctaagtggccctgctgaccacctccccccaggccctttgcctcacatttggggagcc

SEQ ID NO: 329127 - DNA, 446 bp, Homo sapiens
accctgggcccggtgcctgactctgcaccccccgcctgccctaggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggtacgccccacccagtacccaggcccccgaagccctgcacagtgaggaccctcaaggccccatcatgcagataggaaaacagaggtgcctaaaggccaaggaattggctggatcatgaggctcaaaggcatggggctgggatttgggcccagcagccctggggccagcagacaccccctgaccagctctgctctgcctgcaggccccgtgaagcttggcggggaggccgcccacctcccacacctgcggccg

SEQ ID NO: 329128 - DNA, 561 bp, Homo sapiens
  misc_feature (43)..(44): n is a, c, g, or t
ggccgaataggaacagctccggtctacagctcccagcgtgagnnacgcagaagacgggtgatttctgcatttccatctgagtatggatttatcaacacctgtctgcaatctcttgtgatagagaaatttggtgaagaaacatgggaaaaattgaaaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaatcc

SEQ ID NO: 329129 - DNA, 986 bp, Homo sapiens
tgatacctggtttctgttgtaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccaggtagagagcaactgagtacttggcttaatgccaaacatctcacacacaaaagtagaattctgcttatgtgcttaggtgattactgggtaagttgctgtcattaaaatgggtaatgtatcctagcccttttcttctcttgcatatgtccctaatagagatattcctaaggctcctatagtctcaacttttctcaaatttcagaggaggctgcggtgctcaaggttttcctacgattgactgcaagcttcctttgttggtaattcaggacagtgctgagcagttcttcctatttacctagcagggctcaatccatcttaaacaccagctcatttataattcctgcttttatgttcaagcatttcaacaagtggttcaggtttaatgagcagccaacttttcctgcttaggaaattgtgtctccaacatgccatctgacaggttcagaactcaggctgaggtgtgaggctgcctgcagtcagcaggccaggcaccgtgatgccgtaagatattcagaatggctttccttccaccaagtggccactagcgagacatctgctcgcctttctcacagaaaagtacgcttccaagtctggaagtttgttcacactctaaaagttgaacagttttggaggtgaaaaatgaatgtcctcctccgctggctcagcaga

SEQ ID NO: 329130 - DNA, 2752 bp, Homo sapiens
  misc_feature (43)..(44): n is a, c, g, or t
ggccgaataggaacagctccggtctacagctcccagcgtgagnnacgcagaagacgggtgatttctgcatttccatctgaggtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatgtatggatttatcaacacctgtctgcaatctcttgtgatagagaaatttggtgaagaaacatgggaaaaattgaaaacttctgcagaagtacaagatgccttcatgacctacacaatgtatgatgacgtcatcaccattaagctcatccaagaggcctgcaacattctgggagatgaatgcaccatcgtttcgtgtggagagaggagcagatgggaaaatgtttctccattactactcggatagaagtggtctgtgccacattgtaccaggccctccaggcagctttcctcaagatgaaggagaaatatttgaatgtctctgcttgtcctgtgaaaaaatcccactgggatgttgtgagaagcatagtcatgtttggaaaagggcatctcatgaacacctttgagccaatttatcctgagagactctggattgaagagaagacattctgcaacgcttttcctttccacattgtattcgatgaatcactacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggccagatgatctggatggagtccatgtggtgcatggtgtacctgtgctctccgaagctccgcagcctgcaagagctggaagaactcaatatgcatctttctgacatcgcccccaacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaaggggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttgtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaatcc

SEQ ID NO: 329131 - DNA, 921 bp, Homo sapiens
attatctcccatgggacacacacgacttttttgggggggttacttagggaggagcagcagcgagggcacttcagtgattctagtgtgcagtcagcattaagaactatgtctaagaccaaagcaatgcagaagaaagggccctgcagggtctttcttgtgccccactccaccctagcacaaaaagacccagaaggtgacagaaacaagaaaggatagtgtccaggagagctcttcctcaaatgagcctcctctcctccacttcgttctcaagacagtgcatttcctcgttctaggtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaatcc

SEQ ID NO: 329132 - DNA, 855 bp, Homo sapiens
aaatggaggcccatgaggactgtggtgaaggtctgaactctctaccaacctggccaagggcaagggaaggctcgatggagtgccgagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaaggggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaatcc

SEQ ID NO: 329133 - DNA, 456 bp, Homo sapiens
gattgtttcaaaaaaatttattacttccatgatgttgattccattactgaccccctttcccgatagtgagccacagaacatggctagaatgttatttccaaggggaagtttatgggaagggaggttgctttctattcctcagcttatatctgtcctctgtggatagctacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggtaatcactcactcctttcctgttgctccccacctgtttgagagattgatccgaaagggaagaggcagttttc

SEQ ID NO: 329134 - DNA, 3106 bp, Homo sapiens
  misc_feature (43)..(44): n is a, c, g, or t
ggccgaataggaacagctccggtctacagctcccagcgtgagnnacgcagaagacgggtgatttctgcatttccatctgaggtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatgtatggatttatcaacacctgtctgcaatctcttgtgatagagaaatttggtgaagaaacatgggaaaaattgaaaacttctgcagaagtacaagatgccttcatgacctacacaatgtatgatgacgtcatcaccattaagctcatccaagaggcctgcaacattctgggtgtctccatggaagccatcctgaaactctttggagaatactttcaattctgaagatgtctggctatgacaggatgctacggacactgggaggaaatctcatggagtttattgaaaacctggatgccctccacagttacctggcactctcttatcaggagatgaatgcaccatcgtttcgtgtggagagaggagcagatgggaaaatgtttctccattactactcggatagaagtggtctgtgccacattgtaccaggtatcattgaggctgtggccaaagacttctttgatattgatgtaatcatggacattcttgacatgaatgaagaagtggagaggacagggaagaaggagcatgttgtgtttctgattgtacagaaggctcacaggaagatgagaaagacaaagccaaaaaggttacaagacagtcagggcatggagagagaccaagaggccctccaggcagctttcctcaagatgaaggagaaatatttgaatgtctctgcttgtcctgtgaaaaaatcccactgggatgttgtgagaagcatagtcatgtttggaaaagggcatctcatgaacacctttgagccaatttatcctgagagactctggattgaagagaagacattctgcaacgcttttcctttccacattgtattcgatgaatcactacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggccagatgatctggatggagtccatgtggtgcatggtgtacctgtgctctccgaagctccgcagcctgcaagagctggaagaactcaatatgcatctttctgacatcgcccccaacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaaggggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttgtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaatcc

SEQ ID NO: 329135 - DNA, 624 bp, Homo sapiens
ccgtgggactcttttacactttgaacagaaaaatctgtttttaaaactaacttttaattttagaatagtcttagactcacagaaaagttgcaaagatcagtcctgcaaacctcatcccagtctccacattgttaacagactacagaacatgtgtcacaagtagtgagccagggtccatgtattattttaaccgagttcatactttattctgatttcctcagttttttccagctgtcctttttcccttacgttatatttaatccttgcgtctccctagattccttggactatgacagtttctcgtactttctttgttttgggttaccttgtcagttttgaggagcagaggtcaagtgttctgtagaatgtcagtgcattgggatttgtcagatgcttttctcacaggcaggtgatggatttgggggaggaagaccacagagggtgaagtgctcttctcgtcacatcatatcaaaggtactgctggtcttgaatgaacgatcgttttggtgaggtgccatttgtcaggtttttctactgtaaagttacccttccctccttcccctgctccaccatttccatactgtcctctttggaaggaagttactatgtgtggcccactctttt

SEQ ID NO: 329136 - DNA, 136 bp, Homo sapiens
gagaaaaaggagagagatttggatacagtgacacagactctcaaggagaaggccctatgaccacagagacagagactggagtgacgcatctagaagccaaggaccaccaaggatcgcagaaaccatgagaagctga

SEQ ID NO: 329137 - DNA, 4094 bp, Homo sapiens
gcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaa

SEQ ID NO: 329138 - DNA, 754 bp, Homo sapiens
tcataaggacacttataataaaggcagagctggaacccacacttcattccagactgctcagactgagttagtgttagaaaactgaaagtaacatttttattactgtatttcaggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttttttcctttttttttttttttttttttttttttttttttttttttttttttttttatatacaaaaaaaacaaaaaaattaagggggagaaacaccacgccacc

SEQ ID NO: 329139 - DNA, 2613 bp, Homo sapiens
gcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttttttcctttttttttttttttttttttttttttttttttttttttttttttttttatatacaaaaaaaacaaaaaaattaagggggagaaacaccacgccacc

SEQ ID NO: 329140 - DNA, 1697 bp, Homo sapiens
gcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttagtaaacttcagagtggttttctgtaatttattttagttttataggaagatatttcctataaagctgactgccatcgagaagtggagataaagcattatttaatcatgttatctcatttatcgataacctcagaaaagtagaaaacaaaaataataaaaacagaagtattggccttgacagttaattatagaaaacctcagatattaatttgcttttgatttcaaaagatgctgcagttgcatgcattcaattattttaaataatcttttctggctgagtgcagtggctcacgcctgtaatcctagcactttgggaagccgaggcgggcagatcccatgaagccaagagttcgagaacagcttggccaacatggtgaaatcccaactctactagaaatactaaaattagccgggcatggtggcaggcgcctgtaatcccagctactcaggaggctgaggcacgagaatcacttgaacctgggagttggaggttgcagcgagccaagattgcaccattgcgctccagcctgggagacagtgagactct

SEQ ID NO: 329141 - DNA, 4040 bp, Homo sapiens
gcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgctttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaa

SEQ ID NO: 329142 - DNA, 3949 bp, Homo sapiens
  misc_feature (5)..(6): n is a, c, g, or t
  misc_feature (14)..(14): n is a, c, g, or t
  misc_feature (3044)..(3044): n is a, c, g, or t
cccannctgtcttncagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctaggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacanctaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 329143 - DNA, 866 bp, Homo sapiens
  misc_feature (52)..(52): n is a, c, g, or t
gacgacatatactaaccttatgtatatcatatactatgcagggccgccagantaaggaggtggagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccgtaagcaagtttatgattctcatacaccaaagtcaggtatttaaattcaattcggttatgtcttttccaagttcatttgtttgttctcaataaatggctcaagat

SEQ ID NO: 329144 - DNA, 601 bp, Homo sapiens
agccaaggctccctttttagccaagaaaacacacaaaaatgggtaactgcaaggcgaaatgatgcatcatgacacatagatttaaacgaagcaccagagccccagagatacatgtacaggtcaaaaggaagattgcatattataatccttcaagtattactgtcttttctaattcttttgttagtttagcaccttcaagttccttttgtcataaagtctgtgtcctgcttgctgaccctgctctgtgctgctgtgcagtggccttggctgatgctggggctcctgggcctgaacagccagagcactgtattgtgtctccttacagctggcgtatatcggatacctgatgctcttcaactatatcgtgttagtgaagatggaacgctggccgtccacccaggaatggatcgtaatctcctatattttcaccctgggaatagaaaagatgagagaggtaacggcttttataaaagaaaacgtaagagaaagacagtggttaagttctatctgtggatggaggggacaggaagatgcctgggatgcaaattaagccggaaactgttttctctaactctaccacagctgcttctttgctcctctg

SEQ ID NO: 329145 - DNA, 2917 bp, Homo sapiens
  misc_feature (52)..(52): n is a, c, g, or t
  misc_feature (2722)..(2722): n is a, c, g, or t
  misc_feature (2851)..(2851): n is a, c, g, or t
gacgacatatactaaccttatgtatatcatatactatgcagggccgccagantaaggaggtggagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctaggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaaggaatccagccctttctagcttgaccaaacaaaggcatgcctttggnagtgctgaactcaaagtgaacttctggcccaccatccagaaagcttttcgacttgacacatgccgatccaagggatttataggatgttacacctgccttgcacggaggcggatcagaaggggaaagaanagctatagatggatatgtctccgacgtctccccgctaagccctcagacgcgggcaaccaaggcgct

SEQ ID NO: 329146 - DNA, 392 bp, Homo sapiens
  misc_feature (52)..(52): n is a, c, g, or t
gacgacatatactaaccttatgtatatcatatactatgcagggccgccagantaaggaggtggagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagaggtaacggcttttataaaagaaaacgtaagagaaagacagtggttaagttctatctgtg

SEQ ID NO: 329147 - DNA, 95 bp, Homo sapiens
ttcataccaagctcacatactgtggcgaagagctttctgagaaacttcataagattttgctaagatattaatgaataatttagtatattgttgca

SEQ ID NO: 329148 - DNA, 429 bp, Homo sapiens
agtcggctgcttccacaggggctgttcctgttctcggttcggtttcaggcaggtagggctgctggttcctgaatactgtgagtgagcatttccaggttctgtcataactgatctctcatttgctcttcctcaccttcactgctacagctccaccccatggaaccatcttaaagaatcgcctcattactattttgggacatcaaaaatactttaaacacacatgaagtgtcagacaaaatctgcacctaagaaagagggggataatttctttccaacattctcataggaagacactgaaaattctatctttctaaagaaagaggaaaaacaactgtcattttggacaccatcaatatggaagctttgatgatttagctccactcgctctcttgactgcacacactgagaagcattcccagatcatgtcca

SEQ ID NO: 329149 - DNA, 467 bp, Homo sapiens
aatatggtttctcttctcactcaagtttcagattgcagaagactttactgtttgctctgtaattcctgtaacagcaagagtgatatgaaggacaacagaatgccatgaagttctctaatcaggtgagcccatctcattgctgacctaaagcgtatggttggctagctgagaatcctctgatgacggcttgccagttgggcagtagatttctgatgtgaataaacctcaaactgaaaacatgttgagcctatcaatcttgttttgtctgtgaaagggtccacaaaagagcttaggccactggaaatgattagtactagttcatatagaagaaatagtgttgtttaaatgctgtcattgtcttcacgcacagaggtgtgcttaaatctaagtactcccaaatttggaaagaaattattttgaacggattggcataacaagcataactcaaaatgactaagagaagccgg

SEQ ID NO: 329150 - DNA, 216 bp, Homo sapiens
gcggccgcctactactactactactgctcgaattcaagcttctaacgatgtacggggaacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329151 - DNA, 439 bp, Homo sapiens
aaaaaaaaaaaaaaaaaaaaaaaaaaaaaagtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329152 - DNA, 451 bp, Homo sapiens
  misc_feature (9)..(10): n is a, c, g, or t
gcggccgcnncgcctactactactaattcgcggccgcgtcgagtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329153 - DNA, 502 bp, Homo sapiens
  misc_feature (9)..(10): n is a, c, g, or t
gcggccgcnncgcctactactactaattcgcggccgcgtcgagtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtaaaaaaaaaaaagtcgacgcggccgcgaatttagtagtagtaggcggccgc

SEQ ID NO: 329154 - DNA, 637 bp, Homo sapiens
tgatatcgaattcgcggccgcgtcgacacggctgcgagaatacgacagaagggggacgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtcacaaaacaaaaacaaaaataaaaaaatcttctctcctctcatcatctcctctcctctcccctctctactccttccctcctctcccctctcctctatctctccttctctttacactccctctactctcccttccttcttctcttactacacttcatcctctccctctcccc

SEQ ID NO: 329155 - DNA, 808 bp, Homo sapiens
tttgggcttcttaacggctgaatgtttggggtaagagttagttgaggtggaagtggaggctaattgctccccaggaacttaatggttgtaagggcacttaggccacatcgcactctacccacttaaatgatatataactatctcagagcctcaattcccacattaaaatagggatcgtagttgggagttgtgaactttcctcagtgtctaatgcacagaaaccattcaataaatgttattttagtattactgatactgcatctagtaatgagatagctttgttttctgggtttatcaggcctacctgttaatggaaatcagtaatcgttttccttttgattgacttcattttatgtctgctcacatttttgtttttgtttatgataggtaactgtgctcaaaagaaaagtgtatttgaatacagttctgtatatttaatttgtttgttcagtgggattgatccttgtctttcacaactgaatttgatagatgaggaaacaaacataaatgtataaaattttctaggtcttaggttatgtctagaagatttttatttcggaatttaatttctttcttctcttcacaaacattttgacctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329156 - DNA, 393 bp, Homo sapiens
gcgtcgactgcttggcctctttgctcagcttcaccatggcgacggccgtgtggcgcagggaggacccgagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329157 - DNA, 315 bp, Homo sapiens
  misc_feature (39)..(39): n is a, c, g, or t
gctcccacatatattttcaatttcttttcatatactaanatttatggttaccagatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329158 - DNA, 277 bp, Homo sapiens
  misc_feature (34)..(35): n is a, c, g, or t
  misc_feature (44)..(44): n is a, c, g, or t
  misc_feature (58)..(58): n is a, c, g, or t
ccgtccgagactaacggtcgcgccgtgggttctnnccctcagtntcctcctatctccncatccacaccaccccaacgcgctagattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329159 - DNA, 372 bp, Homo sapiens
caatgattgaagctcacgttgatgtcaagactaccgatggttacttgctttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattcacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329160 - DNA, 200 bp, Homo sapiens
  misc_feature (9)..(10): n is a, c, g, or t
gcggccgcnncgcctactactactaattcgcggccgcgtcgaacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329161 - DNA, 2037 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtaaaaaaaaaaaacaaaaaaaaaaaaaaaaaaaaaaaaaaaaaaaaaaagaaaaaaaaaaaaacaaaaaaacaagaaaaacaaaaacaaaaaaaaaaaaagggggggggcgggcagagaagagatcccagggggggcggcccacgcagcacgcgcgcagcccgccgtgtttgttgcacaagggggcgccccacagagagggggcaaaa

SEQ ID NO: 329162 - DNA, 1881 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtaaaaaaaaaaaagtcgacgcggccgcgaatttagtagtagtaggcggccgc

SEQ ID NO: 329163 - DNA, 2172 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtgtgttatgcttgagtcttttttgaattgaacatgctaggattatcaggtaaaaattaagccttttggtactttctcaaaacagggaatttatgtgtgtacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaag

SEQ ID NO: 329164 - DNA, 2001 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtcacaaaacaaaaacaaaaataaaaaaatcttctctcctctcatcatctcctctcctctcccctctctactccttccctcctctcccctctcctctatctctccttctctttacactccctctactctcccttccttcttctcttactacacttcatcctctccctctcccc

SEQ ID NO: 329165 - DNA, 974 bp, Homo sapiens
  misc_feature (9)..(10): n is a, c, g, or t
gcggccgcnncgcctactactactaattcgcggccgcgtcgagtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggtcagtgggagaagaaccgggaaagtgactggagggaagagggtggcggagacagcagccccatttttggccgtcgggggagggagagaaaaataggggacactgccgtgcacggcccctgaggctgtctggtcaagtggggccgatctaacctgagttcgagttcccgttctatcgctttatagttgcatggtctttaagcagtcttgcaatccctccttttctatttttgcatccttaaagtggaggtcatatttctcgggattgtagggagggttggatgaccccagtggatgtgaaagtcactaattcactctctagcactaggtggttctcggggtgtttttcctcaccgctccatgtggtcctaagtggaaagagtcctgttcagggaatcgagacacctcgtgaaagtaccactgccatgaaagcatgattataataatagtcgttggatgcctctgctttcttacctgtacgatgaagggtttggatgatttctattactgcccccattttacaggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329166 - DNA, 402 bp, Homo sapiens
  misc_feature (9)..(10): n is a, c, g, or t
gcggccgcnncgcctactactactaattcgcggccgcgtcgagtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctggcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329167 - DNA, 730 bp, Homo sapiens
  misc_feature (9)..(10): n is a, c, g, or t
gcggccgcnncgcctactactactaattcgcggccgcgtcgagtggttgctgtaaggggtcctccctgcgccacacggccgtcgccatggtgaagctgagcaaagaggccaagcagagactacagcgatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtgtgttatgcttgagtcttttttgaattgaacatgctaggattatcaggtaaaaattaagccttttggtactttctcaaaacagggaatttatgtgtgtacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaag

SEQ ID NO: 329168 - DNA, 1830 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329169 - DNA, 672 bp, Homo sapiens
tgatatcgaattcgcggccgcgtcgacacggctgcgagaatacgacagaagggggacgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtccacaacaaaaacactaatatatctacaataccatctcttaaccccactgacctaccaacactccatcatactctcctacacattctctcttccttcatcatacattcacctaccctcatccatcattcatcccacttctcacccttcattccatcactacccctattccttctctcatactctccctcacttacaacctctaatt

SEQ ID NO: 329170 - DNA, 643 bp, Homo sapiens
  misc_feature (475)..(475): n is a, c, g, or t
  misc_feature (479)..(480): n is a, c, g, or t
tgatatcgaattcgcggccgcgtcgacacggctgcgagaatacgacagaagggggacgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtacacaatanaaannaactaataaaaaaacacttccctaccacactcaatctttattccactccttcttcccattatcaatccctctcttccctctttccctcccacaactcacacttcctcccttctctctcattctctctatatcacacttctatacacctatacttaatcctccc

SEQ ID NO: 329171 - DNA, 2056 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtaaaaaaaaaaaacaaaaaaaaaaaaaaaaaaaaaaaaaaaaaaaaaaagaaaaaaaaagaagaaacgcagagagcacaagggggaggagaaaaaaaacgggaacaagaggagaaagaagacaaaaagcagaaacaaagaagaagaagacgaaaagaagaaaacagggaggggaacaacaaaggagaaccgaaaaaaaacgaaaaacagggagaagacgaaaaaaga

SEQ ID NO: 329172 - DNA, 2026 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtgaaaataaaatggtttttttaaaccagtgctttaacaaaaacaaaaaaaaacaaaaaaacaagaaaaacaaaaacaaaaaaaaaaaaagggggggggcgggcagagaagagatcccagggggggcggcccacgcagcacgcgcgcagcccgccgtgtttgttgcacaagggggcgccccacagagagggggcaaaa

SEQ ID NO: 329173 - DNA, 1883 bp, Homo sapiens
  misc_feature (1394)..(1394): n is a, c, g, or t
  misc_feature (1832)..(1832): n is a, c, g, or t
  misc_feature (1838)..(1838): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtcngatgcngtcaggccccccctcttcctacatcaccttggccttaccgtcccg

SEQ ID NO: 329174 - DNA, 2007 bp, Homo sapiens
  misc_feature (1394)..(1394): n is a, c, g, or t
gcgagtggttaaaagacagttggtgtcggttcgccttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgatttttntcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtaaaaaaaaaaaaaaaaaagaaaaaaaaaaaaacaaaaaaacaagaaaaacaaaaacaaaaaaaaaaaaagggggggggcgggcagagaagagatcccagggggggcggcccacgcagcacgcgcgcagcccgccgtgtttgttgcacaagggggcgccccacagagagggggcaaaa

SEQ ID NO: 329175 - DNA, 458 bp, Homo sapiens
  misc_feature (22)..(22): n is a, c, g, or t
ccgtgatgtggcgcctgcacantcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 329176 - DNA, 91 bp, Homo sapiens
gagagctccttcaggtttctaaggtgggctgtaagggattccttctctaaagtatttgtagtctactacaggagattccagggtattgggg

SEQ ID NO: 329177 - DNA, 6636 bp, Homo sapiens
aattaaattatgagaattaaaaagacaacattgagcagagatgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctacgtcaacctgctcttctggtatcagttcttctgtggtttctccagctccaccatgattgattactggcagatgatattcttcaatctcttctttacctccttgcctcctcttgtctttggagtccttgacaaagacatctctgcagaaacactcctggcattgcctgagctatacaagagtggccagaactctgagtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccatatgaggagctgcagaaatctgtacaaactcaacagaggccacctagtcactggtccacataacccttgaccccttcttcttcatagaggaaacaatgtgccagtcttattcttttcttcaacaaccttgacttccatggaggaagtgctggccccaaggggtctgacacaaagacgggaaacccagtcggcctctagttttctgctgctctcaggcagcacatcttgcaaacagtttggagaaggaggctgtttttgttgaatcgagttctcaaatcggtttagaccaaagccattcttctgaccctctagataagcgtagcctacaacccagtgccgtaagtttccaagattcaagaagtgtatcaacccaggcaatatctcaggatatggaagtttctgggtttatttacccctcagtgcccagagttaaagtttcagaagagacttgtgcacataagggcttcatctcaagtgtattgcagtaatggctgaatcggggttaacatcccttccaggcacagcgagttggttctgctttttgcctgtaagccaaagaaaagccacatctaaaaagctactactaaaagccagaaagaaaagtggatttgaactcagtgtcacagactcttctgagtgttttagggtcacagctagtgtaagaggcatgaagaatagacatgcaaaagggaacgggtgcaccagagacccctgttttggctgacagaccatatgtcccaccagctggggaatctgacaagaggacataggtggcactctttttttaaagctatttattgtatctatttttaaataaaattgcccatcctcattcagctcttagaacaaaagcaaaaaaccctgtaaatcaggagatataagcacatctgcacccagaataggcccatatgatagggcaaccctgagcttaaacaatgacatcttcaagggtagaactaatctgaaacccccttccagcctctggaagacactggcctgcatcagttagagtcagagcaagtgtcacttcacagggaaaagaaggattatatagacttcctatccctagagtttataaatgtcaactatataaaaaaagctcaaaacagtgttaaaggaatgaacagtagaattttaataggctgtccaaagaagccaggtctgctgtgggcaagtatagcctaaccctagtcttgtaaaataagccagaaagggttactgagccaccttaagctagtacctatatagtaggcaaaaagtacagaaatagatgcaataagtgtggtgagtctttgagcctacgagtcatgccaccagccataagttgacctatcacttgagaacctcctcagcaaagatgccagaaaacattcaatcaagttggcaaatgacacagggagctggccctctgaccatcttcctggcaaacctggactggaagggccatttgcagcactgtcctggagctaatacactgtttcactgcctctgccatataatgatgccagcactagccagctggtgggtatttggaggaatcctgcatgaggattgcccaataaggggcaggtacacatacctggcaaagtgatgatgatgtgaattgtttccagtgaggggattgagtcaaaacttggatctcaggtacctcaatttttcccccaatttctggctactactaaaagccagaaagaacagaacagtggcctcaggagatctgagtttgaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataatgctaatgattgtacttagtacatttttatacttttatgatattttactgattggaaatgtcatcctttattaaaaataaacatggttttccatagttgcctgcca

SEQ ID NO: 329178 - DNA, 6673 bp, Homo sapiens
aattaaattatgagaattaaaaagacaacattgagcagagatgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctacgtcaacctgctcttctggtatcagttcttctgtggtttctccagctccaccatgattgattactggcagatgatattcttcaatctcttctttacctccttgcctcctcttgtctttggagtccttgacaaagacatctctgcagaaacactcctggcattgcctgagctatacaagagtggccagaactctgagtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccatatgaggagctgcagaaatctgtacaaactcaacagaggccacctagtcactggtccacataacccttgaccccttcttcttcatagaggaaacaatgtgccagtcttattcttttcttcaacaaccttgacttccatggaggaagtgctggccccaaggggtctgacacaaagacgggaaacccagtcggcctctagttttctgctgctctcaggcagcacatcttgcaaacagtttggagaaggaggctgtttttgttgaatcgagttctcaaatcggtttagaccaaagccattcttctgaccctctagataagcgtagcctacaacccagtgccgtaagtttccaagattcaagaagtgtatcaacccaggcaatatctcaggatatggaagtttctgggtttatttacccctcagtgcccagagttaaagtttcagaagagacttgtgcacataagggcttcatctcaagtgtattgcagtaatggctgaatcggggttaacatcccttccaggcacagcgagttggttctgctttttgcctgtaagccaaagaaaagccacatctaaaaagctactactaaaagccagaaagaaaagtggatttgaactcagtgtcacagactcttctgagtgttttagggtcacagctagtgtaagaggcatgaagaatagacatgcaaaagggaacgggtgcaccagagacccctgttttggctgacagaccatatgtcccaccagctggggaatctgacaagaggacataggtggcactctttttttaaagctatttattgtatctatttttaaataaaattgcccatcctcattcagctcttagaacaaaagcaaaaaaccctgtaaatcaggagatataagcacatctgcacccagaataggcccatatgatagggcaaccctgagcttaaacaatgacatcttcaagggtagaactaatctgaaaccccattcagcctattccagaatggggatagctgaaacccccttccagcctctggaagacactggcctgcatcagttagagtcagagcaagtgtcacttcacagggaaaagaaggattatatagacttcctatccctagagtttataaatgtcaactatataaaaaaagctcaaaacagtgttaaaggaatgaacagtagaattttaataggctgtccaaagaagccaggtctgctgtgggcaagtatagcctaaccctagtcttgtaaaataagccagaaagggttactgagccaccttaagctagtacctatatagtaggcaaaaagtacagaaatagatgcaataagtgtggtgagtctttgagcctacgagtcatgccaccagccataagttgacctatcacttgagaacctcctcagcaaagatgccagaaaacattcaatcaagttggcaaatgacacagggagctggccctctgaccatcttcctggcaaacctggactggaagggccatttgcagcactgtcctggagctaatacactgtttcactgcctctgccatataatgatgccagcactagccagctggtgggtatttggaggaatcctgcatgaggattgcccaataaggggcaggtacacatacctggcaaagtgatgatgatgtgaattgtttccagtgaggggattgagtcaaaacttggatctcaggtacctcaatttttcccccaatttctggctactactaaaagccagaaagaacagaacagtggcctcaggagatctgagtttgaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataatgctaatgattgtacttagtacatttttatacttttatgatattttactgattggaaatgtcatcctttattaaaaataaacatggttttccatagttgcctgcca

SEQ ID NO: 329179 - DNA, 531 bp, Homo sapiens
agtcccctgattcagctgggctttaactggacctgagaatctcaattattaaattcccaggcggttctcatgcaaacagctgtttgggaacagtaccttagaccacctaccttccttacatagcactttactcagccaggcttttgatgaaaagatgtagagagcagacagcttaaggactccctgcattatcttccagggcaacctgacagccaggagagctccttcaggtttctaaggtgggctgtaagggattccttctctaaagtatttgtagtctactacaggagattccagggtattggggatggggatccctgagcatttgtatgtggcctcatgcgggaaaatggctatttgacagtacctgacattaatatggaaaagaagctgagaaaaatccgagcccggacccaaaagcatctagacttgtatgcaagagatggcctgcgcacactatgcattgccaagaaggtaagaacaattcctccaagcgtgctttgaatatcattaaatagctgaatggccttg

SEQ ID NO: 329180 - DNA, 432 bp, Homo sapiens
gaaactcaactgtcggtttcttactatttaagactaacttatccattgaaaaagtcccaattaaattgaaattattcagagcttaaattttcagcatcaatttatatgtcaagctggtctgccacagagtaaaaacctgaaaggaataatgcatgaagccaatatgtttttatgggatgagaaagagaaagaatgaagcaaagatctaaaaatggcacttttcaactggaatagattacgggtggcagggagtgaggtttggagagaagactgggaaagctgaagaggcatattcaaagctataacaccgttttgattttagggggaagtatctgttttcacaattcaaattgcagaaggtaaagttccaccacatcttcttggctgatgaagatgggaagtgggcactgagattgtgtgctcctatcagaa

SEQ ID NO: 329181 - DNA, 408 bp, Homo sapiens
agacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcaggtaaagcaaaaaactctggggaagtcttgggcccagcctgatctttttgtggctgctatcactgcagttactgtttgtagaagggatggagtagggagatatcattattttatttcagggaagctgt

SEQ ID NO: 329182 - DNA, 3048 bp, Homo sapiens
aattaaattatgagaattaaaaagacaacattgagcagagatgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatggtatagaagctcccaagggctccatccctctttctaaaaggaaataccctgctctcctaagaaacgaggagataaaagacattctcctggctctcttagaggctgtgtggcatttccacaagttgcttcctgtatccctgtggtcttccttgtcacagatcagggctgttccaattacttgtaaactttcatttgtttacaaaggttagaagttatcccatatgtggttccccttcagctgatctttgtctggtgccagacaaagcactttatgagacgagttttttatctgtcagcaatggattggagacatttcccaattgtgtgccagtcacacaaccaaggcttaggaatttctcaggccaccttacctgacatgtcagggcaggtctgtgtctaggtgcatggtcagatttaatacatccagaagatgtcttctattctaacagatctcttagcttgtcactgaggcaaagttttgatttaggagatagggctataaaatgcctggactgttaccttgcatggactgaatatgactcataaaactgatctgattccttcagccatcatctgcccaacttggttcccctccccacccccccacaacacacacacacactttctaagaaaagaaaagaaattcttttttttcaatactttaagttctgggatacatgtgcagaatgtgcaggtttgttacataggtatacatgtgtcatggtggtttgcagcacccaccaacccatcatctaccttaggtatttctcctaatgctatccctcccctagcccccaaccccccgatgggctccagtgtgtgatgttcccctccatgtccatgtgttctcattgttcaattcccacttatgagtgagaacatgcagtatttggttttctgttcttgtgttagtttgctgatggtttcctgttcatccgtgtccctgcaaaggacatgaactcatccttttttatggctgcataatattccatggtgtatatgtgccacattttctttatccagtctatcgctgatgggcactggggttggttccaagtctttgctattgtgaacagtgctgcaataaacttacatgtgcatgtgtctttagtagaatgatttataatcctttgggtatatacccagtaatgggattgctggtcaaatggtatttctggttctagatccttgaggaatctttgtcttccacaatggttgaactaatttgtactcccaccaacagtgtaaaagtattcctgtttctctacatcctcttcagcatctgttgtgtcctgacattttaatgatcactattctcactggcgtgagatgttatctcattgtggttttgatttgcatttctctaatgaccagtaatgatgagctttttttcatatgtttgttggctgcataaatgtcttcttttgagaagtgtctgttcatatccttcacccattttttgaagaaaacaaactcttaagagagcagtattcattcttttgagtgtgagggatggagaaagagaaagatggagagagtattataagcagctgtatcccctttgccatggtgatagcagaccattcacatgggagcttctggtctctttgtaataataataagagccacattaccagtacttagagtatgctagttattttaacacattgtatcattaaatcttcaaaacatccctatgagttagaaacct

SEQ ID NO: 329183 - DNA, 6435 bp, Homo sapiens
aattaaattatgagaattaaaaagacaacattgagcagagatgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccatatgaggagctgcagaaatctgtacaaactcaacagaggccacctagtcactggtccacataacccttgaccccttcttcttcatagaggaaacaatgtgccagtcttattcttttcttcaacaaccttgacttccatggaggaagtgctggccccaaggggtctgacacaaagacgggaaacccagtcggcctctagttttctgctgctctcaggcagcacatcttgcaaacagtttggagaaggaggctgtttttgttgaatcgagttctcaaatcggtttagaccaaagccattcttctgaccctctagataagcgtagcctacaacccagtgccgtaagtttccaagattcaagaagtgtatcaacccaggcaatatctcaggatatggaagtttctgggtttatttacccctcagtgcccagagttaaagtttcagaagagacttgtgcacataagggcttcatctcaagtgtattgcagtaatggctgaatcggggttaacatcccttccaggcacagcgagttggttctgctttttgcctgtaagccaaagaaaagccacatctaaaaagctactactaaaagccagaaagaaaagtggatttgaactcagtgtcacagactcttctgagtgttttagggtcacagctagtgtaagaggcatgaagaatagacatgcaaaagggaacgggtgcaccagagacccctgttttggctgacagaccatatgtcccaccagctggggaatctgacaagaggacataggtggcactctttttttaaagctatttattgtatctatttttaaataaaattgcccatcctcattcagctcttagaacaaaagcaaaaaaccctgtaaatcaggagatataagcacatctgcacccagaataggcccatatgatagggcaaccctgagcttaaacaatgacatcttcaagggtagaactaatctgaaacccccttccagcctctggaagacactggcctgcatcagttagagtcagagcaagtgtcacttcacagggaaaagaaggattatatagacttcctatccctagagtttataaatgtcaactatataaaaaaagctcaaaacagtgttaaaggaatgaacagtagaattttaataggctgtccaaagaagccaggtctgctgtgggcaagtatagcctaaccctagtcttgtaaaataagccagaaagggttactgagccaccttaagctagtacctatatagtaggcaaaaagtacagaaatagatgcaataagtgtggtgagtctttgagcctacgagtcatgccaccagccataagttgacctatcacttgagaacctcctcagcaaagatgccagaaaacattcaatcaagttggcaaatgacacagggagctggccctctgaccatcttcctggcaaacctggactggaagggccatttgcagcactgtcctggagctaatacactgtttcactgcctctgccatataatgatgccagcactagccagctggtgggtatttggaggaatcctgcatgaggattgcccaataaggggcaggtacacatacctggcaaagtgatgatgatgtgaattgtttccagtgaggggattgagtcaaaacttggatctcaggtacctcaatttttcccccaatttctggctactactaaaagccagaaagaacagaacagtggcctcaggagatctgagtttgaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataatgctaatgattgtacttagtacatttttatacttttatgatattttactgattggaaatgtcatcctttattaaaaataaacatggttttccatagttgcctgcca

SEQ ID NO: 329184 - DNA, 2994 bp, Homo sapiens
aattaaattatgagaattaaaaagacaacattgagcagagatgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcagggggaagtatctgttttcacaattcaaattgcagaaggtaaagttccaccacatcttcttggctgatgaagatgggaagtgggcactgagattgtgtgctcctatcagaaggaagcaggggttggattccatggaggatattaaccagaagagcactctactgcaggggtgtgggcgtagggcccgtagggcacctacac

SEQ ID NO: 329185 - DNA, 4021 bp, Homo sapiens
  misc_feature (205)..(205): n is a, c, g, or t
  misc_feature (217)..(217): n is a, c, g, or t
  misc_feature (2256)..(2256): n is a, c, g, or t
atggtggccgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctcncgccgccgctgntgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataacccnatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctatgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcaggtgcaaactgaacaatgaggacgcatggacacaggaaggggaacatcacacaccagggcctgttgtggggtggggggaaggggaagggatagcattaggggatatacctaatgttaaatgacgagttaatgggtgcagcacaccaacatggcatatgtatacatatgtaacaaacctgcatgttgtgcacatgtaccctaaaacttaaagtataattaaa

SEQ ID NO: 329186 - DNA, 573 bp, Homo sapiens
gccactaaatttgtagtacatgatgcctggagtccggcttcccgcatctactgcctgcacgacatatacctaggcctaggtatatgtcgtgccatcctgcttcgtcccacctgggataggaatcatcccttggtccagtgtatccacgcccctatgctacccacccactagtgtcttggttatcagatctaaaaatcatagtatatgtagggttcagtactatccatggtttcacgcatccactgggaggctgggaatgtaaccccacagattaagcaggacactatattgccaaatccaaaggatactttttggttctcctcttcttgacttctcggtgatatcaaccaactgactgcttcatgagcgagactcttccagccgtctctgacccatgctgccctactgctgcttcttagcctgcctattatgcaatcttttctattcagcctctcactgttgattttttcccagaccttgaccctggccgtcttctcactctgtgttctctgactggactctgccttccccatctgcagcacgacatatacctagggggatcctctgagcagc

SEQ ID NO: 329187 - DNA, 678 bp, Homo sapiens
aggcagttgggtgagtgatccagatgtcatggatttcgggtgcgtttgctagttagaattgtggtatgatcccgcctttcttccatgccctgttgctctgctgctgcttcattttaacccagaaatgatgttgtaactgagaaaattgagaggcatgttttatgaggttctctttgttgtagtatttttcccaaagaaaatgtcaggtcctgttgattagaaatggtagtccgtttaaaaatatatttttctttctcctagcctgtgaccgctggtcagtgcttcccagacctgatctccaccatgatgtcaacagatttggccattcagcagtcttacacaacaggtaattggagaagtgattgctccttttcttttgtgtttaaaatgaaaataaagggccgggcacggtggctcacgcctgtaattctggcactttgggaggccgaggcgggtggaatacgaggtcaggagatcaagaccatcctggccaacatggtaaagacccatctctactaaaagtacaaaaattagctgggcttggtagtgcgtgcctgtaatcccccctagttgggaggctgaggcaggagaatcacttgaaccagggagttggaggttgccgtgagacgagatcgcgccacagcactccagcctggcaacagagcaagactctgtctc

SEQ ID NO: 329188 - DNA, 8356 bp, Homo sapiens
  misc_feature (2034)..(2034): n is a, c, g, or t
  misc_feature (5497)..(5497): n is a, c, g, or t
atggtggccgcagcggcggcaactgaggcaaggctgaggaggaggacggcggcgacggcagcgctcgcgggcaggagcggcgggccgcactgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataacccnatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctatgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcagattgccttctctcagcacagcaattttatggacctggtacagttcttcgtgactttcttcagttgtttcctctctttgctcctggtggctgctgtggtttggaagatcaaacaaagttgttgggcctccagacgtagagagcaacttcttcgagagatgcaacagatggccagccgtccctttgcctctgtaaatgtcgccttggaaacagatgaggagcctcctgatcttattggggggagtataaagactgttcccaaacccattgcactggagccgtgttttggcaacaaagccgctgtcctctctgtgtttgtgaggctccctcgaggcctgggtggcatccctcctcctgggcagtcaggtcttgctgtggccagcgccctggtggacatttctcagcagatgccgatagtgtacaaggagaagtcaggagccgtgagaaaccggaagcagcagccccctgcacagcctgggacctgcatctgatgctggggccagggactctcccacgcacgagctagtgagtggcacaccagagccatctgcagggaagggcgtggcggggaaatggctgtgcggtgcgggacggaagactggaaaccctcaaagcatctgactcacctgcatgatcacaagctttctttgacggtttctcccatccgtgttccagcatctaaccttttacttttgcataggaaatacttgatttaattacaggtccagggatgagctgatggttgctggaggaggccagtgtagagccagtgagagaactaggaatgacactcaggttcactgtggaaaactgttcttgggactgtctcaactgtgcaaaaaacaaaagatggagtgtttacaagtagacattcgtcatcagttgttcttgaacatggtcttttaaaaactagtcagatgaattaacttgttttcatctgaagcctgctatcttttttaaaagatgtgctatttattcttgcacgatttaggcaattatctctcttccagggagtacctttttttctagttgagaattaataatggtccatctcttttgatcatatcaagctaggatagaaggggggctattttaaatgtcaaggtcagcagtgttactttgaatgtaaactggtataataggtagttttctatagtaacttgattaatttagtcttaatccatttgaaactctctcttcctttctctctgcctgtccctctccttctccatctcaccctccctctctcacacatacacacacaaacacatacacacaacactaagtgcctagactttaaatagatctagcaattggaaagttagtaagcctaagtttttacataattgcattcctacattcttgtaaaatttaaatagctaccattggcaatctgctttttttctaaaatctgatttgcagccaggaaagaattttctcacccaaggaacatttgatctagcagcagggatgagaggaaagcagaaatgaatgaactgtgaaagctcctgtttttattatcaaaaaggacactgtcaagaaggcgccccctgcccccacccccgtgtcaccctaggcctgataagcgatcagaggaaaggactcattcatgtcacgcttccttgagcagaaaagagcactgagagcacttgggacccctggatcagagagcatctgtgtgtcctgcagcctcctctgaacttgtggttcattctcaggctggggtggactcagatgccaggaaagggacagcctcccattgtcaggcagaagctgcccaaagcctggagaaggacttgtttgccctctttcccccaggaggggctcgacccacccaccctccctctcagaccaaggtggtggctgtgaggagggcagcaaatgctgacaaggatgaaaagcacatggaaaaaaatggangaggagggaaaactctgccaaatggaaaatgaccaaatttaagagggtgggacagtcccctgctcctctcccagagggcactgcttggaaattgtgttttccccatttatggtgctctgtattctggcattatgcagcagcctcccagaagctctcttctgcttcaaaacctgggatctctggcattaccctattgggatggaccgctggacagcaatgctcgagtttgtgaatttggagagatactcaaaagagctaaaactgcagcattttacctttaaatgcagtgcctagagagagagtattgtctcttccccaacactaaccccactcccatgaagaattgcctggaaagatgttttcaaggaatttgaaccataaaacactatctgatgcacagaacacctctactttgagactcacctctcataaagcttctttttcacattactgttaaagaccagacgttctagaaaagacccctcctctcatgagctcccccatccctgctacagaacacagcacccatggcgcctgcagtggactggccccttaattcccacaggcccccccagcaaggccaaagggaggcccctgggtattgtcctcctacaaggaagatcctctttgtttgttcaaaggaccagttttcctaggccaaagaagtctcttccccatgttagtcctatgccttgaaatatcatgcaccatgacccacagccatctggttatgtcttatttttttcctaaaagataatgtttatttttaaaaaggaaggaaggagcaagtgaagtttcattctgctccagcggtggggaagccgctgaatccacctgcttctcctttgcaaccgacagcaaacagctttctccggcctcagggcagaaaaagggaatggcagggagtaagaggcgctgggctcggagcctgtttccaagaaggaattggttgtcatctggcagtgttgcgcgtcacaagagagcctgtatataaattaaaatagtcaagacaacactgaccttgcacttgtacataactatacagtagtgtccagaatgttcagacattcggagtgtacataaaacagaaaaaatcttcatgtatttttattaaatataacaatgtctgagtttcacctaagatgtttttgtgccatatgctggatatccaggttctcgccaggccccgatacatgaataacaaacccaagaaacgcatccccattgtgtgatgtgttcagatgcatctggcaccaattaggtatttcttaaaacaggactcatctgtcagagtgcacatgaaaaatcaggcagggaatcgaaacgacagcgctggaggagactcaggaagcagaggcgtccctgccgctgcccttggccctgcaagcacatcatgaccctttctggcagcctcttggtgctctgggtagtgagggatgaccagtcttgtcctgagaaatgtttctcttagtctttaagttcaaagactaacctgtagcaatcagactttccaaaagggggttctccattttttgtagttttgtctaaatttttaatgaccatttcctggaatcagtttattatactgaaaactgggggtgggagtagggagctagtttgttgataaatagttcccatttccccgtggagaatttgacataccctggactcctgtgtgcctcctgccatccctgcacacagcctggggagaagcctgtgcctccccgtgtggagagaaggcaaccccagatcccctgagctaacccggaggaaaggcagtcctggacagaagactgtcagcagaaggaaagtactggactacccgtgggtaagtcctgccattcaagactggagacacctgggaaataaaaagagcagggcactgctggtgggaagaggcattttaccttccagtgcaaatcctgctcctttgatttaatggggtgtactggggccaggggctgattcacttccttgggagatggtggtgttttcatgaacatctttgatccttccatttcatttattcatccatccattcaacaagtatttgctaaacactaacttaagctaatgctagggtagtgactgagatgtaaaaatagattttagaattaaaacaaaatccaagtcctcacacccctgtcatcccaggagatctttccttgtggtggtttctgtgagaattggccatcctgaggacacagccaggacggcagaggcctcctggctcagggcatgccctgcctaccttctgaaatgtttaccccattgaccaaacttggctccagccattgcggtggtttctagatagccaggcccaccaagagatattgccccttgatgagagtcaaacaccctgcctacaaggagatgttttgaaatggagaggaaaattggcacctcatcttttaaaggcagtaatggaattgattttcagtaactgaatttgtgcacaaaacattctaaacactagtgaagcctgtttcgttgaactaattctggctctggaaatgtttttgttttatagttatttacgatttcgtttgtttggattcaagcttagtttgttaatatgtataatttagcatctattacactcatgtaaatatggagtaagtattgtaaactatttcattgcggggattgtgggtgttatacatacatttaggactgcaattttttggtattttttgtattgtaaaataacagctaatttaagcaggaacaagagaactaagggaggtctgtgcattttaaacacaaatgtgaagaacttgtatataaacaaaagtaaatactataatacaaacttccttctgaaataaaagtagatctggtaaaaatgtgaaaaaaatt

SEQ ID NO: 329189 - DNA, 5106 bp, Homo sapiens
  misc_feature (2247)..(2247): n is a, c, g, or t
acgagcttatcccggtttgggtagcatcctccgtcgtatgcagtcaggtctgcttgtggccagctatcaatcttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcagattgccttctctcagcacagcaattttatggacctggtacagttcttcgtgactttcttcagttgtttcctctctttgctcctggtggctgctgtggtttggaagatcaaacaaagttgttgggcctccagacgtagagagcaacttcttcgagagatgcaacagatggccagccgtccctttgcctctgtaaatgtcgccttggaaacagatgaggagcctcctgatcttattggggggagtataaagactgttcccaaacccattgcactggagccgtgttttggcaacaaagccgctgtcctctctgtgtttgtgaggctccctcgaggcctgggtggcatccctcctcctgggcagtcaggtcttgctgtggccagcgccctggtggacatttctcagcagatgccgatagtgtacaaggagaagtcaggagccgtgagaaaccggaagcagcagccccctgcacagcctgggacctgcatctgatgctggggccagggactctcccacgcacgagctagtgagtggcacaccagagccatctgcagggaagggcgtggcggggaaatggctgtgcggtgcgggacggaagactggaaaccctcaaagcatctgactcacctgcatgatcacaagctttctttgacggtttctcccatccgtgttccagcatctaaccttttacttttgcataggaaatacttgatttaattacaggtccagggatgagctgatggttgctggaggaggccagtgtagagccagtgagagaactaggaatgacactcaggttcactgtggaaaactgttcttgggactgtctcaactgtgcaaaaaacaaaagatggagtgtttacaagtagacattcgtcatcagttgttcttgaacatggtcttttaaaaactagtcagatgaattaacttgttttcatctgaagcctgctatcttttttaaaagatgtgctatttattcttgcacgatttaggcaattatctctcttccagggagtacctttttttctagttgagaattaataatggtccatctcttttgatcatatcaagctaggatagaaggggggctattttaaatgtcaaggtcagcagtgttactttgaatgtaaactggtataataggtagttttctatagtaacttgattaatttagtcttaatccatttgaaactctctcttcctttctctctgcctgtccctctccttctccatctcaccctccctctctcacacatacacacacaaacacatacacacaacactaagtgcctagactttaaatagatctagcaattggaaagttagtaagcctaagtttttacataattgcattcctacattcttgtaaaatttaaatagctaccattggcaatctgctttttttctaaaatctgatttgcagccaggaaagaattttctcacccaaggaacatttgatctagcagcagggatgagaggaaagcagaaatgaatgaactgtgaaagctcctgtttttattatcaaaaaggacactgtcaagaaggcgccccctgcccccacccccgtgtcaccctaggcctgataagcgatcagaggaaaggactcattcatgtcacgcttccttgagcagaaaagagcactgagagcacttgggacccctggatcagagagcatctgtgtgtcctgcagcctcctctgaacttgtggttcattctcaggctggggtggactcagatgccaggaaagggacagcctcccattgtcaggcagaagctgcccaaagcctggagaaggacttgtttgccctctttcccccaggaggggctcgacccacccaccctccctctcagaccaaggtggtggctgtgaggagggcagcaaatgctgacaaggatgaaaagcacatggaaaaaaatggangaggagggaaaactctgccaaatggaaaatgaccaaatttaagagggtgggacagtcccctgctcctctcccagagggcactgcttggaaattgtgttttccccatttatggtgctctgtattctggcattatgcagcagcctcccagaagctctcttctgcttcaaaacctgggatctctggcattaccctattgggatggaccgctggacagcaatgctcgagtttgtgaatttggagagatactcaaaagagctaaaactgcagcattttacctttaaatgcagtgcctagagagagagtattgtctcttccccaacactaaccccactcccatgaagaattgcctggaaagatgttttcaaggaatttgaaccataaaacactatctgatgcacagaacacctctactttgagactcacctctcataaagcttctttttcacattactgttaaagaccagacgttctagaaaagacccctcctctcatgagctcccccatccctgctacagaacacagcacccatggcgcctgcagtggactggccccttaattcccacaggcccccccagcaaggccaaagggaggcccctgggtattgtcctcctacaaggaagatcctctttgtttgttcaaaggaccagttttcctaggccaaagaagtctcttccccatgttagtcctatgccttgaaatatcatgcaccatgacccacagccatctggttatgtcttatttttttcctaaaagataatgtttatttttaaaaaggaaggaaggagcaagtgaagtttcattctgctccagcggtggggaagccgctgaatccacctgcttctcctttgcaaccgacagcaaacagctttctccggcctcagggcagaaaaagggaatggcagggagtaagaggcgctgggctcggagcctgtttccaagaaggaattggttgtcatctggcagtgttgcgcgtcacaagagagcctgtatataaattaaaatagtcaagacaacactgaccttgcacttgtacataactatacagtagtgtccagaatgttcagacattcggagtgtacataaaacagaaaaaatcttcatgtatttttattaaatataacaatgtctgagtttcacctaagatgtttttgtgccatatgctggatatccaggttctcgccaggccccgatacatgaataacaaacccaagaaacgcatccccattgtgtgatgtgttcagatgcatctggcaccaattaggtatttcttaaaacaggactcatctgtcagagtgcacatgaaaaatcaggcagggaatcgaaacgacagcgctggaggagactcaggaagcagaggcgtccctgccgctgcccttggccctgcaagcacatcatgaccctttctggcagcctcttggtgctctgggtagtgagggatgaccagtcttgtcctgagaaatgtttctcttagtctttaagttcaaagactaacctgtagcaatcagactttccaaaagggggttctccattttttgtagttttgtctaaatttttaatgaccatttcctggaatcagtttattatactgaaaactgggggtgggagtagggagctagtttgttgataaatagttcccatttccccgtggagaatttgacataccctggactcctgtgtgcctcctgccatccctgcacacagcctggggagaagcctgtgcctccccgtgtggagagaaggcaaccccagatcccctgagctaacccggaggaaaggcagtcctggacagaagactgtcagcagaaggaaagtactggactacccgtgggtaagtcctgccattcaagactggagacacctgggaaataaaaagagcagggcactgctggtgggaagaggcattttaccttccagtgcaaatcctgctcctttgatttaatggggtgtactggggccaggggctgattcacttccttgggagatggtggtgttttcatgaacatctttgatccttccatttcatttattcatccatccattcaacaagtatttgctaaacactaacttaagctaatgctagggtagtgactgagatgtaaaaatagattttagaattaaaacaaaatccaagtcctcacacccctgtcatcccaggagatctttccttgtggtggtttctgtgagaattggccatcctgaggacacagccaggacggcagaggcctcctggctcagggcatgccctgcctaccttctgaaatgtttaccccattgaccaaacttggctccagccattgcggtggtttctagatagccaggcccaccaagagatattgccccttgatgagagtcaaacaccctgcctacaaggagatgttttgaaatggagaggaaaattggcacctcatcttttaaaggcagtaatggaattgattttcagtaactgaatttgtgcacaaaacattctaaacactagtgaagcctgtttcgttgaactaattctggctctggaaatgtttttgttttatagttatttacgatttcgtttgtttggattcaagcttagtttgttaatatgtataatttagcatctattacactcatgtaaatatggagtaagtattgtaaactatttcattgcggggattgtgggtgttatacatacatttaggactgcaattttttggtattttttgtattgtaaaataacagctaatttaagcaggaacaagagaactaagggaggtctgtgcattttaaacacaaatgtgaagaacttgtatataaacaaaagtaaatactataatacaaacttccttctgaaataaaagtagatctggtaaaaatgtgaaaaaaatt

SEQ ID NO: 329190 - DNA, 2539 bp, Homo sapiens
cttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctaggaggcccctgggtattgtcctcctacaaggaagatcctctttgtttgttcaaaggaccagttttcctaggccaaagaagtctcttccccatgttagtcctatgccttgaaatatcatgcaccatgacccacagccatctggttatgtcttatttttttcctaaaagataatgtttatttttaaaaaggaaggaaggagcaagtgaagtttcattctgctccagcggtggggaagccgctgaatccacctgcttctcctttgcaaccgacagcaaacagctttctccggcctcagggcagaaaaagggaatggcagggagtaagaggcgctgggctcggagcctgtttccaagaaggaattggttgtcatctggcagtgttgcgcgtcacaagagagcctgtatataaattaaaatagtcaagacaacactgaccttgcacttgtacataactatacagtagtgtccagaatgttcagacattcggagtgtacataaaacagaaaaaatcttcatgtatttttattaaatataacaatgtctgagtttcacctaagatgtttttgtgccatatgctggatatccaggttctcgccaggccccgatacatgaataacaaacccaagaaacgcatccccattgtgtgatgtgttcagatgcatctggcaccaattaggtatttcttaaaacaggactcatctgtcagagtgcacatgaaaaatcaggcagggaatcgaaacgacagcgctggaggagactcaggaagcagaggcgtccctgccgctgcccttggccctgcaagcacatcatgaccctttctggcagcctcttggtgctctgggtagtgagggatgaccagtcttgtcctgagaaatgtttctcttagtctttaagttcaaagactaacctgtagcaatcagactttccaaaagggggttctccattttttgtagttttgtctaaatttttaatgaccatttcctggaatcagtttattatactgaaaactgggggtgggagtagggagctagtttgttgataaatagttcccatttccccgtggagaatttgacataccctggactcctgtgtgcctcctgccatccctgcacacagcctggggagaagcctgtgcctccccgtgtggagagaaggcaaccccagatcccctgagctaacccggaggaaaggcagtcctggacagaagactgtcagcagaaggaaagtactggactacccgtgggtaagtcctgccattcaagactggagacacctgggaaataaaaagagcagggcactgctggtgggaagaggcattttaccttccagtgcaaatcctgctcctttgatttaatggggtgtactggggccaggggctgattcacttccttgggagatggtggtgttttcatgaacatctttgatccttccatttcatttattcatccatccattcaacaagtatttgctaaacactaacttaagctaatgctagggtagtgactgagatgtaaaaatagattttagaattaaaacaaaatccaagtcctcacacccctgtcatcccaggagatctttccttgtggtggtttctgtgagaattggccatcctgaggacacagccaggacggcagaggcctcctggctcagggcatgccctgcctaccttctgaaatgtttaccccattgaccaaacttggctccagccattgcggtggtttctagatagccaggcccaccaagagatattgccccttgatgagagtcaaacaccctgcctacaaggagatgttttgaaatggagaggaaaattggcacctcatcttttaaaggcagtaatggaattgattttcagtaactgaatttgtgcacaaaacattctaaacactagtgaagcctgtttcgttgaactaattctggctctggaaatgtttttgttttatagttatttacgatttcgtttgtttggattcaagcttagtttgttaatatgtataatttagcatctattacactcatgtaaatatggagtaagtattgtaaactatttcattgcggggattgtgggtgttatacatacatttaggactgcaattttttggtattttttgtattgtaaaataacagctaatttaagcaggaacaagagaactaagggaggtctgtgcattttaaacacaaatgtgaagaacttgtatataaacaaaagtaaatactataatacaaacttccttctgaaataaaagtagatctggtaaaaatgtgaaaaaaatt

SEQ ID NO: 329191 - DNA, 2121 bp, Homo sapiens
  misc_feature (205)..(205): n is a, c, g, or t
  misc_feature (217)..(217): n is a, c, g, or t
atggtggccgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctcncgccgccgctgntgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattggtaagtttcccaaaaccattttctcttcaggcatctttttgcctatactataagcagcatttaaaaggagactgaaaatattgccagttcaaaatgatcaggccatttgaaagaggtccaaatggtattttttatattcatttgactaatgttacacatctggtaaaaattatttctacattaaattctttttgaaatcactcctgttaattgcttgaatgctaatttttaaggctgagttgaggtgtctagtctctcctttgtcatgttatgcctacctggtagtgttacatagttgcaaccaccagcattgtgttaagactgtggttcacgta

SEQ ID NO: 329192 - DNA, 3799 bp, Homo sapiens
  misc_feature (2034)..(2034): n is a, c, g, or t
atggtggccgcagcggcggcaactgaggcaaggctgaggaggaggacggcggcgacggcagcgctcgcgggcaggagcggcgggccgcactgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataacccnatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctatgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcaggtgcaaactgaacaatgaggacgcatggacacaggaaggggaacatcacacaccagggcctgttgtggggtggggggaaggggaagggatagcattaggggatatacctaatgttaaatgacgagttaatgggtgcagcacaccaacatggcatatgtatacatatgtaacaaacctgcatgttgtgcacatgtaccctaaaacttaaagtataattaaa

SEQ ID NO: 329193 - DNA, 4048 bp, Homo sapiens
  misc_feature (2034)..(2034): n is a, c, g, or t
atggtggccgcagcggcggcaactgaggcaaggctgaggaggaggacggcggcgacggcagcgctcgcgggcaggagcggcgggccgcactgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataacccnatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctatgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcagattgccttctctcagcacagcaattttatggacctggtacagttcttcgtgactttcttcagaccttgaccctggccgtcttctcactctgtgttctctgactggactctgccttccccatctgcagcacgacatgcccagaagtgaccaattccatccttcctcaccggtgttccccacctcactaactggcaacatggctctgctggttccaagccacttctcttgctttcactcagcaggcactcccttaccaggccccagagctgtggccgtcagtgcactctccacctccactccccaccccaccaaccctagcatcacagtctcgcctggaccttttcacttgactttggcccctccagaatccacaaaaagtccagagaagacctttaaagatcatgtatctagccccttaccttcctgtcgtatctaaaataaaattcagcgtcctgggtgaactggcgtc

SEQ ID NO: 329194 - DNA, 4689 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag
